(12) United States Patent
Landfield et al.

(10) Patent No.: US 7,739,056 B2
(45) Date of Patent: Jun. 15, 2010

(54) BIOMARKERS FOR AGING

(75) Inventors: Philip Landfield, Lexington, KY (US); Eric Blalock, Lexington, KY (US); Kuey-Chu Chen, Lexington, KY (US); Thomas Foster, Gainesville, FL (US)

(73) Assignee: University of Kentucky Research Foundation, Lexington, KY (US)

( * ) Notice: Subject to any disclaimer, the term of this patent is extended or adjusted under 35 U.S.C. 154(b) by 0 days.

(21) Appl. No.: 12/379,520

(22) Filed: Feb. 24, 2009

(65) Prior Publication Data

US 2009/0263804 A1    Oct. 22, 2009

Related U.S. Application Data

(62) Division of application No. 10/486,706, filed as application No. PCT/US02/25607 on Aug. 13, 2002, now abandoned.

(60) Provisional application No. 60/311,343, filed on Aug. 13, 2001.

(51) Int. Cl.
 *G06F 7/00*  (2006.01)
(52) U.S. Cl. .............................. 702/19; 702/20; 703/11; 435/6; 436/501
(58) Field of Classification Search ........................ None
 See application file for complete search history.

(56) References Cited

U.S. PATENT DOCUMENTS

| | | | |
|---|---|---|---|
| 6,080,848 A | 6/2000 | Henrichwark et al. | |
| 6,083,920 A | 7/2000 | Rosenberg | |
| 6,172,041 B1 | 1/2001 | McCabe et al. | |
| 6,180,678 B1 | 1/2001 | Milgram et al. | |
| 6,222,027 B1 | 4/2001 | Kaser et al. | |
| 6,363,399 B1 * | 3/2002 | Maslyn et al. | 707/104.1 |
| 6,569,624 B1 * | 5/2003 | Weindruch et al. | 435/6 |
| 2002/0119462 A1 | 8/2002 | Mendrick et al. | |
| 2007/0027634 A1 | 2/2007 | Mendrick et al. | |

OTHER PUBLICATIONS

Goldbaum et al., "Stress proteins in oligodendrocytes: differential effects of heat shock and oxidative stress", Journal of Neurochemistry, 2001, vol. 78, pp. 1233-1242.

Liau et al., "Identification of a Human Glioma-associated Growth Factor Gene, Granulin, Using Differential Immuno-absorption", Cancer Research, Mar. 1, 2000, vol. 60, pp. 1353-1360.

Nelson et al., Age-Related Changes in Proopiomelanocortin Messenger Ribonucleic Acid Levels in Hypothalamus and Pituitary of Female C57BL/6J Mice, Endocrinology, 1988, vol. 123, No. 1, pp. 340-344.

Hung et al. "Age-dependent increase in C7-1 gene expression in rat frontal cortex", 2000, Molecular Brain Research, vol. 75, pp. 330-336.

* cited by examiner

*Primary Examiner*—Mary K Zeman
(74) *Attorney, Agent, or Firm*—McDermott Will & Emery LLP

(57) ABSTRACT

A statistical and functional correlation strategy to identify changes in cellular pathways specifically linked to impaired cognitive function with aging. Analyses using the strategy identified multiple groups of genes expressed in the hippocampi of mammals, where the genes were expressed at different levels for several ages. The aging changes in expression began before mid-life. Many of the genes were involved in specific neuronal and glial pathways with previously unrecognized relationships to aging and/or cognitive decline. These identified genes and the proteins they encode can be used as novel biomarkers of brain aging and as targets for developing treatment methods against age-related cognitive decline, Alzheimer's Disease and Parkinson's Disease.

9 Claims, 6 Drawing Sheets

BIOMARKERS FOR AGING

RELATED APPLICATIONS

This application a Divisional of U.S. application Ser. No. 10/486,706, filed Aug. 13, 2004, now abandoned which is a U.S. National Phase under 35 U.S.C. §371 of International Application No. PCT/US2002/25607, filed on Aug. 13, 2002, claiming priority of U.S. Provisional Application No. 60/311, 343, filed Aug. 13, 2001, the entire contents of each of which are hereby incorporated by reference.

STATEMENT OF GOVERNMENT INTEREST

This invention has been made in part with government support under grants AG04542, AG10836, AG18228 and AG14979 from the National Institute on Aging, and by MH59891. The government of the United States of America may have certain rights in this invention.

FIELD OF THE INVENTION

The invention relates generally to genetic algorithms, and more particularly to the identification of gene expression profile biomarkers and therapeutic targets for brain aging.

BACKGROUND OF THE INVENTION

Brain aging processes are enormously complex phenomena that affect multiple systems, cell types and pathways, and result in cognitive decline and increased risk of Alzheimer's disease (AD). Landfield P W et al., *J Neurobiol* 23: 1247-1260 (1992). Although several biological mechanisms have been putatively linked to brain aging or Alzheimer's disease, including inflammation, oxidative stress, $Ca^{2+}$ dyshomeostasis (Landfield, P W & Pitler T A, *Science* 226: 1089-1092 (1984); Landfield P W et al., *J Neurobiol* 23: 1247-1260 (1992)), mitochondrial dysfunction and chronic exposure to adrenal stress hormones (Landfield P W et al., *Science* 214: 581-584 (1981); Porter N M & Landfield P W, *Nature Neurosci* 1: 3-4 (1998)), the specific mechanisms and pathways, if any, through which they are linked to impaired brain function are not understood.

It is widely thought that gene expression changes contribute to many aspects of declining function with aging. Finch C E, *Longevity, Senescence and the Genome*, 37-42 (Univ. Chicago Press, Chicago, 1990). It is also thought that gene expression changes are important for processing and storage of memory. However, not all genes that change expression in the brain with aging are thought to be important for cognition.

Gene-expression changes that specifically contribute to age-related memory decline should selectively change with brain aging and should be correlated specifically with measures of age-associated cognitive decline; that is, a subset of the full set of aging-dependent genes should also correlate with age-related cognitive decline. See, Lockhart D J & Barlow C, *Nat Rev Neurosci* 2: 63-68 (2001) and Mirnics K, *Nat Rev Neurosci* 2: 444-447 (2001).

If a subset of age-dependent genes also shows expression patterns directly correlated with age-related memory decline, then such a subset of "aging and cognition-related genes" (ACGs) would be extremely helpful as biological indexes ("biomarkers") for assessing or diagnosing the degree of age-related cognitive impairment in individual subjects. In turn, the ability to measure aging-related cognitive impairment quantitatively is essential for discovering new therapeutic targets, and developing new strategies and pharmaceutical compounds for counteracting normal age-related cognitive decline and/or age-related neurodegenerative diseases, including Alzheimer's disease (AD) or Parkinson's disease (PD).

Identifying ACGs in any mammalian species therefore, might have great therapeutic usefulness. Moreover, because of the well-established homologies of most genes across mammalian species and because of the clear similarities in patterns of brain aging and cognitive decline across species, identification in any mammal would have human health implications. Furthermore, because the primary risk factor for Alzheimer's disease and Parkinson's disease is aging itself, therapeutic approaches developed for aging-related cognitive impairment should also help ameliorate cognitive decline from age-related neurodegenerative disease. Thus, there is a clear need for identifying ACGs but, to date, such genes have not been discovered for any mammal.

Gene microarray technology provides a powerful approach for unraveling the complex processes of aging. To date, however, its impact has been limited by statistical problems, small sample sizes, and difficulty in assessing functional relevance. Moreover, studies that have examined gene expression during brain aging using microarrays have not used sample sizes large enough to provide adequate statistical power for formal statistical testing. Lee C K et al., *Nature Genetics* 25: 294-297 (2000); Jiang C H et al., *Proc Natl Acad Sci USA* 98: 1930-1934 (2001) Therefore, even the genes they have reported to change with aging have not been validated by accepted statistical criteria.

The extremely large data sets generated by microarrays pose formidable bioinformatics and resource problems that have to date limited the impact of this powerful technology. Because of these difficulties, most microarray studies have relied on simple fold change comparisons in small samples. However, neither fold change analyses nor the small sample protocols widely used allow the direct estimates of variance necessary for defining type I error (false positives). In addition, fold change criteria, by definition, select for large changes. Therefore, they exhibit low detection sensitivity (high false negatives, or type II error), and are unable to identify the modest changes that often characterize functionally important (and, therefore, tightly regulated) genes. The inability to assign type I error is a particularly critical problem for microarray studies because the thousands of comparisons of gene expression in such analyses greatly increase the expected false positives. For example, even if group sizes were sufficient for formal statistical analyses, and 5000 gene transcripts were each tested by t-test for differences between two conditions at $p \leq 0.05$, the false positive rate is equal to the p-value and, consequently, 5% of the 5000 tested transcripts (250) would be expected to be found significant by chance alone.

Although microarray studies have some important offsetting advantages that improve statistical confidence (e.g., co-regulation of genes within a functional group), there is increasing recognition that microarray experiments should generally meet the same statistical standards as other biological experiments or, at least, should systematically estimate the degree of statistical uncertainty. Several strategies to improve statistical confidence have been developed for small-sample microarray studies, but these generally rely on indirect estimates of variance and/or greatly sacrifice sensitivity (i.e., stringent p-values).

Another highly important problem of microarray studies is that of determining which of the hundreds of expression changes that may be observed are likely to be functionally relevant. Correlation analysis is one quantitative approach to linking gene expression with function, although it also requires relatively large sets of independent samples. Expression-function correlations fulfill a key prediction of a causal relationship (i.e., that causally related variables should covary) and therefore, can serve as a valuable tool for the identification of candidate functionally relevant genes. Nonetheless, there have been few correlation studies attempting to link cognitive dysfunction with univariate gene expression patterns across individual subjects, much less using the massive amounts of data generated in microarray analyses.

SUMMARY OF THE INVENTION

The invention provides a statistical and functional correlation strategy to identify changes in cellular pathways specifically linked to impaired cognitive function with aging. The bioinformatics and functional correlation strategy improves the power of microarray analyses and provides the ability to test whether alterations in specific hippocampal pathways are correlated with aging-related cognitive impairment. The invention is useful for application in large, well-powered groups and for controlling type I error (false positives), enhancing detection sensitivity (reducing type II false negatives) and determining which aging changes in expression are most closely correlated with declining brain function.

Accordingly, the invention provides a method for identifying a biomarker for brain aging, where the biomarker is a polynucleotide or a polypeptide encoded by said polynucleotide. The method involves first obtaining a set of polynucleotides obtained from a set of brain samples (such as hippocampal samples), where the members of the set of brain samples were obtained from members of a set of mammals, wherein the set of mammals contains more than two members, with at least young, mid-aged and aged members, and then identifying the identity and amount of the members of the set of polynucleotides present in the brain samples. The method then involves the steps of deleting certain non-biomarker polynucleotides from the set of polynucleotides, testing by a conventional statistical method (such as) for a significant effect of aging across the young, mid-aged and aged members; and correlating the identity and amount of the members of the set of polynucleotides present in the brain samples with cognitive performance in behavioral tests.

By use of the methods of the invention, one skilled in the genomics art can identify multiple groups of related genes, many representing processes with previously unrecognized relationships to aging and/or cognitive dysfunction. Thus, the invention also provides compositions of matter comprising sets of genes, expressed sequence tags (ESTs), polynucleotides and polypeptides encoded by said polynucleotides identified as being involved in the aging processes. These sets usefully result in a statistically validated, comprehensive overview of mammalian, including human, functional brain aging. In particular, the set of genes can be used for the diagnosis of human age-related disease, such as an age-related neurodegenerative condition, including Alzheimer's disease or Parkinson disease.

The invention provides a set of biomarkers for brain aging, where (a) the set of biomarkers comprises at least two members; (b) the brain expression patterns of the members of the set are significantly altered with aging as determined by a conventional statistical method (such as ANOVA or student's t test), with $p<0.05$; (c) the brain expression patterns of the members of the set are correlated (using a conventional statistical correlation test, e.g., tested by Pearson's or Spearman's correlation test) across age groups with cognitive performance in behavioral tests, with a correlation of $p<0.05$ (or with a more stringent correlation of $p<0.01$ or $p<0.001$) between brain expression and cognitive performance; and (d) the cognitive performance in behavioral tests significantly altered with aging as determined by a conventional statistical method. The biomarkers may also correlate with a behavioral measure of functional impairment, such as an age-related neurodegenerative condition, including Alzheimer's disease or Parkinson's disease.

The invention also provides a set of at least two biomarkers for brain aging, where where the brain expression patterns of the members of the set are significantly altered with aging as measured by a conventional statistical correlation test at a significance level of $p<0.01$.

The invention further provides a set of at least two biomarkers for brain aging, where the brain expression patterns of the members of the set are significantly altered with aging as determined by a conventional statistical method, with $p<0.05$ (or a more stringent correlation, such as $p<0.025$, $p<0.01$ or $p<0.001$).

In one example of the invention, rats in three age groups (Young, Mid-Aged, Aged) were characterized on two memory tasks and each mammal's hippocampal CA1 region was analyzed by a microarray analysis for gene expression. These analyses identified multiple groups of genes, many representing pathways with previously unrecognized relationships to aging and/or cognitive decline. The analysis showed that for all groups, the aging changes in expression began by mid-life.

In one aspect of the invention, the known interactions of the identified processes suggest an integrative model of specific cellular cascades that begin in mid-life and eventually impair cognitive function and increase neuronal vulnerability. Initially decreased neuronal activity and/or oxidative metabolism trigger separate but parallel genomic cascades in neurons and glia. In neurons, the cascade results in reductions of immediate early gene signaling, biosynthesis, synaptogenesis and neurite remodeling. In contrast, glia undergo increased lipid metabolism and mediate a cycle of demyelination and remyelination that induces antigen presentation, inflammation, oxidative stress and extracellular restructuring. Intervention studies based on these findings can identify the cause and effect interactions among the complex processes of brain aging.

BRIEF DESCRIPTION OF THE DRAWINGS

FIG. 1A) and object memory task (OMT; FIG. 1B) in comparison to either Young or Mid-Aged animals (*$p<0.05$, **$p<0.01$, by 1-way ANOVA and Tukey's post-hoc). As shown in the bar graph, the Young and Mid-Aged animals did not differ significantly from each on either the SWM or OMT task. On the SWM task (FIG. 1A), higher platform crossings reflects greater retention of the spot where the platform was previously located. For the OMT (FIG. 1B), a higher memory index reflects greater retention of the previously explored object, and resultant increased exploration of the novel object.

DETAILED DESCRIPTION OF THE INVENTION

The concept of "biomarker" is well-known and useful concept for those of skill in the genomic art. In general, a biomarker is a measurable biological manifestation that is a quantitative indication of the presence and degree of an underlying biological process of interest.

We have devised a multi-stage method for the identification of biomarkers for brain aging, using gene expression microarrays and behavioral testing. The method of the invention allows one skilled in the genomics art to identify both "aging and cognition-related genes" (ACGs) and unique genes that change with brain aging alone, based on formal statistical testing.

As used in this specification, the word "cognitive" is defined as comprising the higher order intellectual/brain processes involved in learning, including attention, acquisition, short-term memory, long-term memory and memory retrieval, among others.

As used in this specification, across different mammalian species, age definitions are as follows: "Young" mammals are those at or beyond reproductive maturity for the species. "Mid-aged" is defined in two ways: at or around half the average lifespan for the species and at or around the midpoint between reproductive maturity and average lifespan. "Aged" mammals are those at or around average lifespan. Animals intermediate between two ages could be considered as part of the group to which they are most closely chronologically related (with the exception of young animals, for whom it would be inappropriate to include prepubescent individuals)

We used the bioinformatics and functional correlation strategy of the invention for microarray analyses. As a result, we were able to detect multiple groups of related genes that were altered by brain aging and also correlated with cognitive function across individual subjects. Most of the shifts in genomic regulation began by mid-life, well before the onset of measurable cognitive impairment, implying that cognitive function is not altered substantially without further progression and/or the cumulative effects of the initial changes in gene regulation.

This analysis depended on a novel combination of three approaches for microarray research: (a) the quantitative measurement of the dependent function of interest (cognitive performance), which provided a basis for large-scale expression-function correlation analyses; (b) the application of formal statistical analyses (ANOVA, Pearson's) to large groups of independent microarray samples, which conferred substantial statistical power and high detection sensitivity for even modest changes (low false negative type II error); and c) systematic estimates of the maximum probabilities of false positives in our data. Our results using the method of the invention provide a generally comprehensive overview of hippocampal genes/processes that are altered with brain aging and closely linked to brain functional decline.

Figure 1:
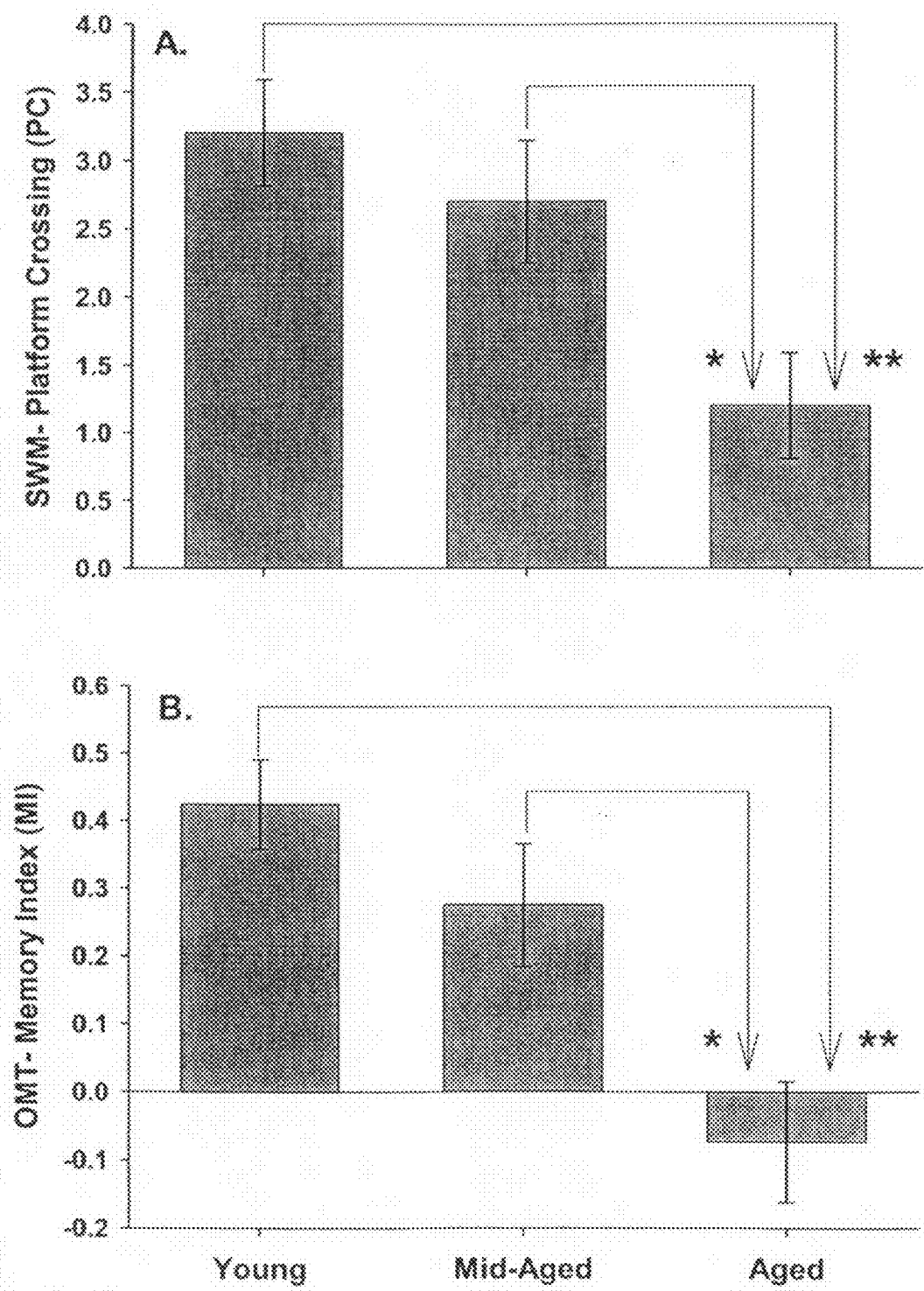
FIG. 1 is a set of bar graphs showing age-dependent impairment of memory performance. Male Fischer 344 rats aged 4 months (Young, n=10), 13 months (Mid-Aged, n=10) and 24 months (Aged, n=10) were used. Aged animals exhibited significantly reduced performance on 24 hr memory retention on both the Morris spatial water maze task (SWM.

To verify the method of the invention, we first tested young (3-4 months old), mid-aged (12-13 months old) and aged (24-25 months old) rats (n=9-10 per group) for performance on the Morris spatial water maze (SWM) and object memory task (OMT). Both behavioral tests clearly and reliably (statistically) revealed aging-related cognitive impairment (FIG. 1).

We then anesthetized (for euthanasia) all animals and dissected out a region of the brain (CA1 region of the hippocampus) known to be important for memory. These brain tissues were then prepared for analyses of gene expression profiles (mRNA content) on Affymetrix GeneChip microarrays specific for the rat genome (RG-U34A arrays) (one array for each individual rat sample). The microarrays were then read and analyzed for expression profile data on an Affymetrix GeneChip System according to the manufacturer's instructions.

The behavioral and microarray methods that were used can reasonably be expected to apply as well to mice as to rats. Similar behavioral and microarray methods known to those of skill in the art can be used for testing of other mammals, including humans. The utility of the method of the invention for human testing is discussed below.

Figure 2:
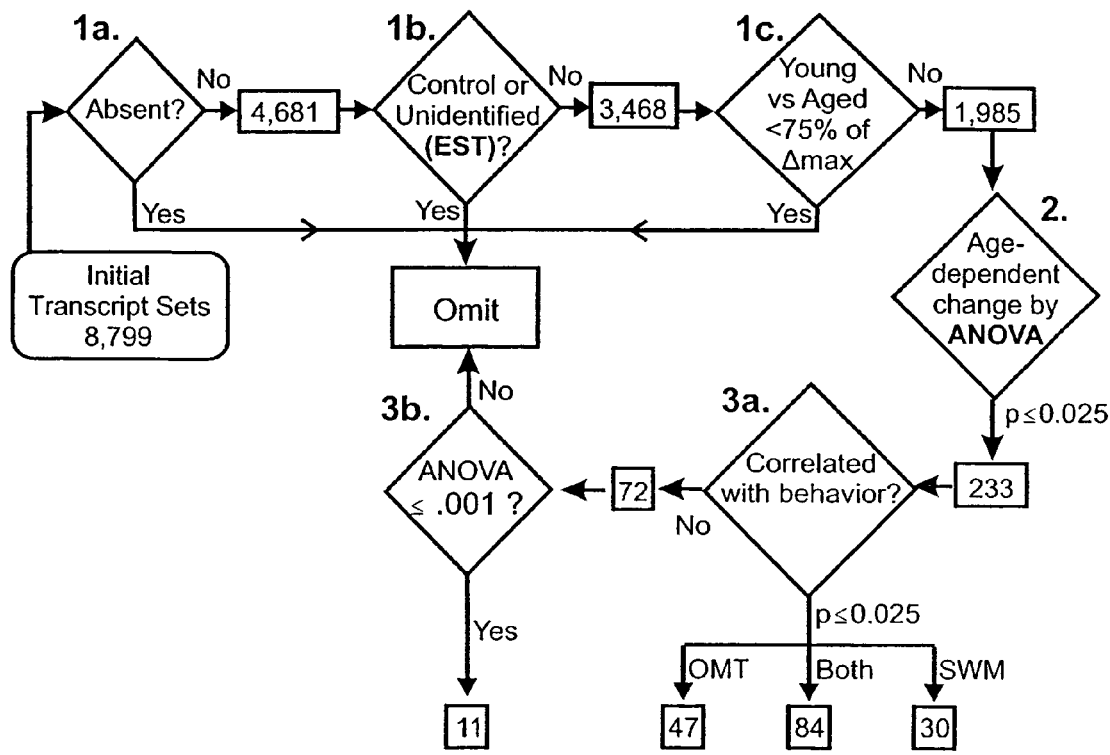
FIG. 2 is a flow chart for a filtering and statistical test algorithm for identifying primary set of ACGs. The flow chart also includes the results for an example of the invention. An initial set of 8,799 transcript sets contained on the U34A Gene Chip (see, EXAMPLE 2) was filtered prior to statistical testing, to reduce expected false positives. Probe sets were removed if they were called "absent" (1a.), if they were unknown expressed sequence tags (ESTs) (1b.) or if the difference between the Young and Aged groups did not comprise at least 75% of the maximal normalized age differences (1c.). Each of the remaining 1,985 transcript (gene) sets was then tested by ANOVA across the three age groups (n=9–10) to determine if it changed significantly with aging (2.). Each of the 233 genes that changed significantly with age ($p \leq 0.025$) was then tested across all animals (n=29) for significant behavioral correlation with OMT, SWM, or both SWM and OMT (Pearson's; 3a). Furthermore, of the genes that did not correlate with behavior, ones that showed an ANOVA p value$\leq 0.001$ were also retained for further analysis (3b). In total, 172 genes were considered, 161 of which could be considered ACGs.

We then transferred the data into standard computer spreadsheets (e.g., Excel) for performing statistical analyses of the effects of aging. Using Analysis of Variance (ANOVA) we defined the set of genes whose degree of expression changed significantly with brain aging. We then used that set of "Aging Genes" and tested each gene's expression profile (across only the aged animals) for significant correlation with memory performance on the Object Memory Task (OMT) as well as the Morris spatial water maze (SWM). The "Aging Genes" whose expression patterns correlated significantly with cognitive performance were defined as the primary subset of "Aging and Cognition-Related Genes" (ACGs), and subcategorized as OMT-associated, SWM-associated, or both OMT and SWM-associated. We further included genes with no behavioral association that had an ANOVA p value$\leq 0.001$ since genes identified at this more stringent level are less subject to the error of multiple testing (FIG. 2, TABLES 1A and 1B).

Based on those large-scale studies, we have developed a list of ACGs that appear to have considerable potential importance for assessing and generating new treatments for age-dependent functional decline (TABLES 1A and 1B).

These lists contain some genes that were identified previously as being linked to brain aging or neurodegeneration (e.g., inflammation or mitochondrial genes, Lee C K et al., Nature Genetics 25: 294-297 (2000)) but none has been previously shown to be specifically associated with both brain aging and aging-dependent cognitive impairment. Further, many genes on our list have not even been shown previously to be linked to brain aging alone or to cognition alone. Thus, our lists of ACGs are unique and useful biomarkers and therapeutic targets specifically for aging-dependent cognitive impairment. In addition, our list of all genes that change with brain aging contains many genes never before reported to change with brain aging, and therefore provides a useful and unique panel of gene biomarkers and therapeutic targets for study and treatment of brain aging.

In addition to these lists for identified genes, we have also performed the same analyses and compiled the same lists for unidentified expressed sequence tags (ESTs) that are on the same Affymetrix Chips (TABLE 2). These are valuable data, because once the ESTs are identified, they can provide therapeutic targets.

Using the method of the invention, we were able to identify a number of processes and pathways that previously have not been clearly associated with normal brain aging. The most unexpected findings included altered expression profiles suggestive of increased myelin and lipid turnover, as well as widespread changes indicating coordinated downregulation of oxidative metabolism, decreased neurite outgrowth and synaptogenesis. Other novel genes we identified appear to suggest alterations in general metabolic and biosynthetic chaperone functions. In addition, many of the identified groups confirmed previously described changes in expression for genes regulating several major processes (e.g., inflammation, glial reactivity, oxidative stress). However, our results also extend the earlier findings considerably by revealing the extent of the changes and the concurrent upregulation of potentially orchestrating transcription factors and cytokines that may provide important clues to pathogenic mechanisms.

In order to begin to develop an integrative overview of potential interactions among the multiple altered expression patterns observed here, we considered functional implications at the pathway level. Our interpretations rely on the functions that have been previously associated with many of the genes identified by those of skill in the genomics art. These are identified through PubMed literature searches, annotations provided by Affymetrix, entries in the SwissProtein database and associations reported in the Genome Ontology (GO). We also rely on the general assumption held by those of skill in the genomics art that similar changes in the expression of multiple genes of a particular pathway imply like changes in the functions mediated by the encoded proteins of that pathway. Gene expression changes also can reflect compensatory negative feedback regulation (or other dissociations of gene expression and protein function), but the potential confound of dissociation is presumably less of a problem in microarray analyses in which multiple genes in a pathway are observed to change in the same direction. Some of the primary metabolic pathways and processes considered in the interpretations are depicted in TABLE 1.

Functional Groups. We found age-dependent upregulation of many ACGs involved in inflammatory/immune/stress responses and downregulation of many involved in energy metabolism. In addition, we found alterations of gene expression reflecting multiple categories/pathways not previously recognized to change with normal aging. These included upregulation of genes for myelin proteins, cholesterol biosynthesis and transport, amino acid metabolism, intracellular $Ca^{2+}$ signaling, and protein processing, as strongly suggesting an ongoing cycle of remyelination and demyelination. We also found widespread downregulation of genes for biosynthesis, immediate early responses, and synaptic structural plasticity, suggestive of neuronal involvement. Multiple transcriptional regulators and cytokines were also identified that may play orchestrating roles. Nearly all expression changes began by mid-life but cognition was not impaired until late life. Upregulated genes for inflammation and intracellular $Ca^{2+}$ release were among those most closely correlated with impairment.

TABLE 1A

Functionally Grouped ACGs and Genes Showing
Highly Significant Age-Dependent Decreases in Expression

| SEQ ID NO: | GenBank | Description | Young | Mid | Aged | ANOVA p | beh all |
|---|---|---|---|---|---|---|---|
| | | Synaptic Structural Plasticity | | | | | |
| SEQ ID NO: 1 | M64780* | Agrn, Agrin | 2746 ± 105 | 2334 ± 74 | 2207 ± 79 | 0.0005 | Both |
| SEQ ID NO: 2 | L21192 | GAP-43, membrane attached signal protein 2 (brain) | 10324 ± 546 | 8990 ± 327 | 8165 ± 480 | 0.0095 | Both |
| SEQ ID NO: 3 | S82649 | Narp, neuronal activity-regulated pentraxin | 4358 ± 300 | 3470 ± 143 | 3247 ± 185 | 0.0029 | OMT |
| SEQ ID NO: 4 | M74223 | VGF, neurosecretory protein | 6697 ± 373 | 5836 ± 387 | 4722 ± 369 | 0.0042 | OMT |
| SEQ ID NO: 5 | U63740* | Fez1, Protein kinase C-binding protein Zeta1 | 10339 ± 180 | 9322 ± 258 | 9388 ± 330 | 0.0239 | OMT |
| SEQ ID NO: 6 | AB003726 | Homer1a, RuvB-like protein 1 | 3546 ± 270 | 2354 ± 121 | 2469 ± 132 | 0.0001 | None |
| SEQ ID NO: 7 | U19866 | Arc, activity-regulated cytoskeleton-associated protein | 6374 ± 527 | 4408 ± 228 | 4094 ± 398 | 0.0008 | None |
| | | Transcription Regulator | | | | | |
| SEQ ID NO: 8 | M18416 | Egr1, Early growth response 1 (Krox-24) | 4911 ± 259 | 3688 ± 177 | 3544 ± 165 | 0.0001 | Both |
| SEQ ID NO: 9 | M92433 | NGFI-C, Zinc-finger transcription factor | 2037 ± 149 | 1576 ± 44 | 1495 ± 170 | 0.0009 | Both |
| SEQ ID NO: 10 | L08595 | Nuclear receptor subfamily 4, group A, member 2 | 1467 ± 80 | 1186 ± 83 | 1011 ± 62 | 0.0010 | Both |
| SEQ ID NO: 11 | AI030089 | Nopp130, nucleolar phosphoprotein p130 | 471 ± 31 | 397 ± 31 | 314 ± 22 | 0.0022 | Both |
| SEQ ID NO: 12 | AF016387 | RXRG, retinoid X-receptor gamma | 1900 ± 129 | 1503 ± 95 | 1365 ± 103 | 0.0059 | Both |
| SEQ ID NO: 13 | AA800794 | HT2A, zinc-finger protein | 2480 ± 67 | 2396 ± 41 | 2097 ± 73 | 0.0004 | OMT |
| SEQ ID NO: 14 | AA799641 | S164, Contains a PWI domain associated with RNA splicing | 7645 ± 169 | 7690 ± 183 | 6842 ± 250 | 0.0106 | OMT |
| SEQ ID NO: 15 | U78102 | Egr2, Early growth response 2 | 576 ± 95 | 223 ± 21 | 205 ± 23 | 0.0001 | SWM |
| SEQ ID NO: 16 | U44948 | SmLIM, smooth muscle cell LIM protein | 1166 ± 15 | 928 ± 55 | 887 ± 38 | 0.0001 | SWM |
| SEQ ID NO: 17 | AA891717 | USF-1, upstream stimulatory factor 1 | 3607 ± 142 | 2993 ± 91 | 3025 ± 66 | 0.0003 | None |
| SEQ ID NO: 18 | AF095576 | Aps, adaptor protein with pleckstrin and src homology | 526 ± 40 | 275 ± 49 | 272 ± 46 | 0.0007 | None |
| | | Intracellular Signal Transduction | | | | | |
| SEQ ID NO: 19 | AI176689 | MAPKK 6, mitogen-activated protein kinase kinase 6 | 2012 ± 84 | 1781 ± 92 | 1528 ± 88 | 0.0030 | Both |
| SEQ ID NO: 20 | X89703 | TPCR19, Testis Polymerase Chain Reaction product 19 | 361 ± 25 | 320 ± 25 | 252 ± 24 | 0.0155 | Both |
| SEQ ID NO: 21 | L04485 | MAPPK1, mitogen-activated protein kinase kinase 1 | 13110 ± 365 | 11951 ± 312 | 11200 ± 506 | 0.0104 | OMT |
| SEQ ID NO: 22 | AA817892 | Gnb2, Guanine nucleotide binding protein (beta 2subunit) | 6500 ± 159 | 5606 ± 214 | 5765 ± 218 | 0.0110 | OMT |
| SEQ ID NO: 23 | AF000901 | P58/P45, Nucleoporin p58 | 597 ± 43 | 444 ± 51 | 391 ± 47 | 0.0150 | OMT |
| SEQ ID NO: 24 | M87854 | Beta-ARK-1, beta adrenergic receptor kinase 1 | 1994 ± 110 | 1723 ± 90 | 1544 ± 114 | 0.0202 | OMT |
| SEQ ID NO: 25 | AF058795 | Gb2, GABA-B receptor | 9443 ± 360 | 9064 ± 478 | 7857 ± 323 | 0.0228 | OMT |
| SEQ ID NO: 26 | AA800517 | VAP1, vesicle associated protein | 637 ± 72 | 674 ± 61 | 455 ± 35 | 0.0228 | OMT |
| | | Signal Transduction | | | | | |
| SEQ ID NO: 27 | AF003904 | CRH-binding protein | 773 ± 51 | 782 ± 35 | 630 ± 23 | 0.0119 | Both |
| SEQ ID NO: 28 | M15191 | Tac1, Tachykinin | 1415 ± 110 | 1078 ± 57 | 1068 ± 74 | 0.0093 | OMT |
| SEQ ID NO: 29 | AF091563 | Olfactory receptor | 440 ± 21 | 367 ± 29 | 332 ± 27 | 0.0233 | SWM |
| SEQ ID NO: 30 | M64376 | Olfactory protein | 810 ± 26 | 605 ± 83 | 568 ± 57 | 0.0247 | SWM |
| SEQ ID NO: 31 | M15880 | Npy, Neuropeptide Y | 4647 ± 158 | 3561 ± 223 | 3668 ± 141 | 0.0004 | None |
| | | Adhesion, Extracellular Matrix | | | | | |
| SEQ ID NO: 32 | M27207 | Col1a1, Procollagen-type I (alpha 1) | 678 ± 24 | 521 ± 43 | 480 ± 23 | 0.0005 | Both |
| SEQ ID NO: 33 | AF104362 | Omd, Osteomodulin (osteoadherin) | 289 ± 16 | 217 ± 24 | 185 ± 15 | 0.0024 | Both |
| SEQ ID NO: 34 | D63886 | MMP16, matrix metalloproteinase 16 | 664 ± 23 | 604 ± 37 | 542 ± 19 | 0.0180 | Both |
| SEQ ID NO: 35 | M21354 | Col3a1, collagen type III alpha-1 | 203 ± 22 | 157 ± 13 | 132 ± 9 | 0.0120 | SWM |
| SEQ ID NO: 36 | AB010437 | CDH8, Cadherin-8 | 163 ± 24 | 100 ± 12 | 83 ± 17 | 0.0128 | SWM |
| | | Metabolism | | | | | |
| SEQ ID NO: 37 | L03294 | Lp1, lipoprotein lipase | 1147 ± 69 | 918 ± 40 | 749 ± 37 | 0.0000 | Both |
| SEQ ID NO: 38 | S68245 | Ca4, carbonic anhydrase 4 | 2272 ± 75 | 1993 ± 63 | 1825 ± 54 | 0.0002 | Both |
| SEQ ID NO: 39 | AA859975 | LOC64201, 2-oxoglutarate carrier | 4792 ± 68 | 4370 ± 102 | 4255 ± 97 | 0.0010 | Both |
| SEQ ID NO: 40 | M24542 | RISP, Rieske iron-sulfur protein | 10337 ± 308 | 9095 ± 327 | 8833 ± 128 | 0.0013 | Both |
| SEQ ID NO: 41 | M18467 | Got2, glutamate oxaloacetate transaminase 2 | 9470 ± 241 | 8355 ± 179 | 8332 ± 322 | 0.0061 | Both |
| SEQ ID NO: 42 | X64401 | Cyp3a3, Cytochrome P450-subfamily III (polypeptide 3) | 805 ± 64 | 762 ± 51 | 581 ± 34 | 0.0089 | Both |
| SEQ ID NO: 43 | U83880 | glycerol-3-phosphate dehydrogenase, mitochondrial | 2054 ± 73 | 1988 ± 77 | 1673 ± 111 | 0.0127 | Both |

TABLE 1A-continued

Functionally Grouped ACGs and Genes Showing
Highly Significant Age-Dependent Decreases in Expression

| SEQ ID NO: | GenBank | Description | Young | Mid | Aged | ANOVA p | beh all |
|---|---|---|---|---|---|---|---|
| SEQ ID NO: 44 | J05499 | GLS, glutaminase (mitochondrial) | 915 ± 24 | 844 ± 44 | 787 ± 14 | 0.0238 | Both |
| SEQ ID NO: 45 | U90887 | Arg2, arginase type II | 499 ± 21 | 374 ± 31 | 364 ± 22 | 0.0015 | OMT |
| SEQ ID NO: 46 | M22756 | Ndufv2, mitochondrial NADH dehydrogenase (24 kDa) | 12293 ± 574 | 10193 ± 670 | 9260 ± 750 | 0.0134 | SWM |
| Transporters, Carriers | | | | | | | |
| SEQ ID NO: 47 | L46873 | Slc15a1, Oligopeptide transporter | 426 ± 30 | 411 ± 24 | 292 ± 27 | 0.0028 | Both |
| SEQ ID NO: 48 | AB000280 | PHT1, peptide/histidine transporter | 802 ± 20 | 659 ± 40 | 691 ± 37 | 0.0198 | OMT |
| SEQ ID NO: 49 | U87627 | MCT3, putative monocarboxylate transporter | 687 ± 33 | 521 ± 22 | 480 ± 38 | 0.0002 | SWM |
| SEQ ID NO: 50 | AA799389 | Rab3B, ras-related protein | 353 ± 21 | 324 ± 25 | 251 ± 23 | 0.0150 | SWM |
| Growth, Biosynthesis, Maintenance | | | | | | | |
| SEQ ID NO: 51 | X16554 | Prps1, Phosphoribosyl pyrophosphate synthetase 1 | 3159 ± 81 | 2747 ± 74 | 2637 ± 97 | 0.0006 | Both |
| SEQ ID NO: 52 | U66470 | rCGR11, Cell growth regulator | 820 ± 31 | 676 ± 31 | 662 ± 38 | 0.0051 | Both |
| SEQ ID NO: 53 | M37584 | H2AZ, H2A histone family (member Z) | 5335 ± 73 | 4906 ± 186 | 4600 ± 162 | 0.0090 | Both |
| SEQ ID NO: 54 | U90610 | Cxcr4, CXC chemokine receptor | 811 ± 56 | 812 ± 59 | 614 ± 29 | 0.0109 | Both |
| SEQ ID NO: 55 | AA874794 | Bex3, brain expressed X-linked 3 | 16735 ± 376 | 14986 ± 588 | 14238 ± 457 | 0.0047 | OMT |
| SEQ ID NO: 56 | AA892506 | coronin, actin binding protein 1A | 4101 ± 121 | 3625 ± 114 | 3558 ± 135 | 0.0104 | OMT |
| SEQ ID NO: 57 | AA893939* | DSS1, deleted in split hand/split foot protein 1 | 4201 ± 76 | 3860 ± 129 | 3658 ± 141 | 0.0149 | OMT |
| SEQ ID NO: 58 | AF087037 | Btg3, B-cell translocation gene 3 | 652 ± 55 | 676 ± 71 | 460 ± 29 | 0.0163 | OMT |
| SEQ ID NO: 59 | U06099 | Prdx2, Peroxiredoxin 2 | 12667 ± 675 | 11742 ± 641 | 10339 ± 272 | 0.0216 | OMT |
| SEQ ID NO: 60 | AI172476 | Tieg-1, TGF-beta-inducible early growth response protein 1 | 1127 ± 99 | 925 ± 63 | 812 ± 53 | 0.0177 | SWM |
| SEQ ID NO: 61 | AA866411 | Necdin, neuronal growth suppressor | 1994 ± 81 | 1568 ± 86 | 1542 ± 62 | 0.0005 | None |
| Protein Processing and Trafficking | | | | | | | |
| SEQ ID NO: 62 | X54793 | Hsp60, heat shock protein 60 | 10088 ± 333 | 9602 ± 299 | 8693 ± 229 | 0.0071 | Both |
| SEQ ID NO: 63 | AA875047 | TCPZ, T-complex protein 1 (zeta subunit) | 997 ± 161 | 728 ± 99 | 470 ± 59 | 0.0095 | Both |
| SEQ ID NO: 64 | D21799 | Psmb2, Proteasome subunit (beta type 2) | 7298 ± 242 | 6892 ± 229 | 6395 ± 177 | 0.0241 | Both |
| SEQ ID NO: 65 | U53922 | Hsj2, DnaJ-like protein (RDJ1) | 10716 ± 382 | 8836 ± 190 | 8392 ± 204 | 0.0000 | SWM |
| SEQ ID NO: 66 | X78605 | rab4b, ras-homologous (GTPase | 3131 ± 292 | 2040 ± 196 | 2006 ± 135 | 0.0012 | None |

For TABLE 1A, "GenBank" is the gene accession number established at the web accessible GenBank database, The "Description" includes a 'common name' (if applicable) as well as a brief description of the gene product. Values for Young, Mid-Aged, and Aged categories are the mean±SEM of expression values. Genes are put into functional categories (see, above) and grouped by their level of association with behavior (expression correlated significantly (Pearson's; ≦0.025) with both tasks, with the OMT, with the SWM, or with none of the tasks but highly significant across age (≦0.001 on ANOVA across age, p>0.025 for correlation on both SWM and OMT). Within each level of association, genes are ranked by the significance of the age-dependent change in their expression level (ANOVA; ≦0.025). Asterisked (*) genes are those that also showed a significant behavioral correlation (Pearson; ≦0.025).

ACGs that were downregulated with aging (TABLE 1A) appeared primarily to represent metabolic and neuronal functions (FIG. 3a).

Metabolism. Multiple genes related to functions of the mitochondrial electron transport chain (e.g., glycerol 3-phosphate dehdrogenase, NADH dehydrogenase, Rieske's iron-sulpher protein) were downregulated with aging (TABLE 1A). Moreover, we found aging-dependent downregulation of several genes related to pathways important for glucogenic amino acid catabolism, including glutaminase and arginase (TABLE 1A).

Synaptic Structural Plasticity. One of the most prominent categories of identified genes showing decreased expression and behavioral correlation was that comprising genes involved in synaptic structural plasticity, including neurite outgrowth and synaptogenesis (e.g., decreased expression of genes encoding agrin, GAP-43, Homer 1a, Narp, Arc, etc.) (TABLE 1A). Many of these genes are activity-dependent in neurons and have been linked previously to synaptic plasticity, neurite remodeling or learning in univariate studies (e.g., Biewenga J E et al., *Acia Biochim Pol* 43: 327-38 (1996); Steward O et al., *Neuron* 21: 741-51 (1998), Mantych K B & Ferreira A, *J Neurosci* 21: 6802-9 (2001), Guzowski J F et al., *J Neurosci* 20: 3993-4001 (2000), Bezakova G, et al. *Proc Natl Acad Sci USA* 98 9924-9 (2001)), although Gap-43 is one of the few reported so far to change with aging. Similarly, many other neural activity-dependent genes, including IEGs in the Transcription Regulators and Signaling categories (e.g., Egr1, Egr2, MAPKK, etc.), showed decreased expression with aging and were correlated with impaired cognition (TABLE 1A).

In addition, multiple genes important for general growth and biosynthetic mechanisms, chaperone functions and protein processing were also downregulated with aging (e.g., hsp60, histone H2AZ, proteasome subunit, DNA J-like homolog, etc.) as were specific neuronal signaling genes (e.g., GluR 5-2, the kainate receptor; and neuropeptide Y) (TABLE 1A). These widely downregulated biosynthetic and signaling genes appear to reflect a general involution of metabolic and neurite structural remodeling processes in neurons (e.g., FIG. 4, TABLE 1A). Chaperone proteins such as the DNA-J-like homolog and hsp60 play critical roles in preventing protein aggregates (Satyal S H et al., *Proc Natl Acad Sci USA* 97 5750-5 (2000)), which are known to be critical in Alzheimer's disease (Price D L & Sisodia S S, *Annu Rev Neurosci* 21: 479-505 (1998), Kovacs D M & Tanzi R E, *Cell Mol Life Sci* 54: 902-9 (1998); Sisodia S S et al., *Am J Hum Genet* 65: 7-12 (1999), Tanzi R E & Parson A B (2000), Selkoe D J, *Neuron* 32: 177-80 (2001)), and could therefore have implications for age-dependent vulnerability to Alzheimer's disease.

TABLE 1B

ACGs and Genes Showing Highly Significant Age-Dependent Increases in Expression

| SEQ ID NO: | GenBank | Description | Young | Mid | Aged | ANOVA p | beh all |
|---|---|---|---|---|---|---|---|
| | | Inflammation, Defense, Immunity | | | | | |
| SEQ ID NO: 69 | J04488 | Ptgds, Prostaglandin D synthase | 3976 ± 248 | 6891 ± 350 | 8365 ± 438 | 0.0000 | Both |
| SEQ ID NO: 70 | X71127 | C1qb, complement component 1-q (beta polypeptide) | 885 ± 52 | 1461 ± 85 | 1895 ± 102 | 0.0000 | Both |
| SEQ ID NO: 71 | J03752 | Microsomal GST-1, glutathione S-transferase | 368 ± 43 | 695 ± 60 | 910 ± 45 | 0.0000 | Both |
| SEQ ID NO: 72 | L40362* | MHC class I RT1.C-type protein | 1755 ± 64 | 2106 ± 82 | 2501 ± 77 | 0.0000 | Both |
| SEQ ID NO: 73 | U17919 | Aif1, allograft inflammatory factor 1 | 712 ± 29 | 990 ± 47 | 1152 ± 67 | 0.0000 | Both |
| SEQ ID NO: 74 | M15562 | MHC class II RT1.u-D-alpha chain | 608 ± 73 | 1194 ± 238 | 2120 ± 173 | 0.0000 | Both |
| SEQ ID NO: 75 | X13044 | Cd74, CD74 antigen | −49 ± 44 | 155 ± 83 | 603 ± 100 | 0.0000 | Both |
| SEQ ID NO: 76 | M24324 | RTS, MHC class I RT1 (RTS(u haplotype) | 3274 ± 175 | 4599 ± 363 | 5822 ± 342 | 0.0000 | Both |
| SEQ ID NO: 77 | M32062 | Fcgr3, Fc IgG receptor III (low affinity) | 347 ± 25 | 462 ± 32 | 557 ± 21 | 0.0000 | Both |
| SEQ ID NO: 78 | AJ222813 | Il18, interleukin 18 | 110 ± 33 | 208 ± 14 | 261 ± 16 | 0.0002 | Both |
| SEQ ID NO: 79 | L40364 | RT1Aw2, RT1 class Ib | 2033 ± 126 | 2546 ± 127 | 2842 ± 115 | 0.0004 | Both |
| SEQ ID NO: 80 | AI231213 | Kangai 1, suppression of tumorigenicity 6 | 2727 ± 116 | 2952 ± 120 | 3484 ± 139 | 0.0008 | Both |
| SEQ ID NO: 81 | AI170268 | Ptgfr, Prostaglandin F receptor | 6651 ± 248 | 8057 ± 336 | 8502 ± 359 | 0.0013 | Both |
| SEQ ID NO: 82 | X52477 | C3, Complement component 3 | 34 ± 49 | 236 ± 83 | 476 ± 100 | 0.0034 | Both |
| SEQ ID NO: 83 | X73371 | FCGR2, Low affinity immunoglobulin gamma Fc receptor II | 218 ± 19 | 285 ± 24 | 384 ± 21 | 0.0001 | OMT |
| SEQ ID NO: 84 | X78848 | Gsta1, Glutathione-S-transferase (alpha type) | 3145 ± 74 | 3909 ± 188 | 4155 ± 204 | 0.0009 | OMT |
| SEQ ID NO: 85 | AA818025* | Cd59, CD59 antigen | 6465 ± 265 | 7269 ± 163 | 7474 ± 189 | 0.0052 | OMT |
| SEQ ID NO: 86 | AA891810 | GST, Glutathione S-transferase | 1136 ± 83 | 1411 ± 70 | 1791 ± 101 | 0.0001 | SWM |
| SEQ ID NO: 87 | U92081 | Gp38, Glycoprotein 38 | 547 ± 26 | 679 ± 38 | 802 ± 66 | 0.0037 | SWM |
| SEQ ID NO: 88 | X62322 | Grn, Granulin | 4514 ± 145 | 4972 ± 254 | 5375 ± 119 | 0.0116 | SWM |
| | | Transcription Regulator | | | | | |
| SEQ ID NO: 89 | X13167* | NF1-A, nuclear factor 1 A | 112 ± 30 | 265 ± 38 | 300 ± 26 | 0.0008 | Both |
| SEQ ID NO: 90 | U67082 | KZF-1, Kruppel associated box (KRAB) zinc finger 1 | 472 ± 31 | 565 ± 32 | 617 ± 29 | 0.0099 | Both |
| SEQ ID NO: 91 | U92564 | Roaz, Olf-1/EBF associated Zn finger protein | 429 ± 50 | 687 ± 71 | 761 ± 50 | 0.0014 | OMT |
| SEQ ID NO: 92 | L16995 | ADD1, adipocyte determ./different.-dependent factor 1 | 784 ± 100 | 1054 ± 75 | 1179 ± 95 | 0.0160 | OMT |
| SEQ ID NO: 93 | AI237535 | LitaF, LPS-induced TNF-alpha factor | 979 ± 62 | 1078 ± 68 | 1338 ± 114 | 0.0193 | OMT |
| SEQ ID NO: 94 | AI177161 | Nfe212, NF-E2-related factor 2 | 544 ± 31 | 590 ± 36 | 687 ± 25 | 0.0096 | SWM |
| | | Signal Transduction | | | | | |
| SEQ ID NO: 95 | U26356 | S100A1, S100 protein (alpha chain) | 1382 ± 105 | 1636 ± 75 | 1999 ± 115 | 0.0008 | Both |
| SEQ ID NO: 96 | AA850219 | Anx3, Annexin A3 | 438 ± 26 | 501 ± 21 | 575 ± 26 | 0.0023 | Both |
| SEQ ID NO: 97 | D84477 | Rhoa, ras-related homolog A2 | 749 ± 108 | 1069 ± 111 | 1319 ± 85 | 0.0024 | Both |
| SEQ ID NO: 98 | AF048828 | VDAC1, voltage-dependent anion channel 1 | 2334 ± 294 | 3157 ± 392 | 3844 ± 290 | 0.0137 | Both |
| SEQ ID NO: 99 | AI102103 | Pik4cb, Phosphatidylinositol 4-kinase | 975 ± 63 | 1029 ± 67 | 1252 ± 80 | 0.0247 | Both |
| SEQ ID NO: 100 | L35921 | Ggamma, GTP-binding protein (gamma subunit) | 498 ± 30 | 543 ± 43 | 712 ± 64 | 0.0108 | SWM |
| SEQ ID NO: 101 | M83561 | GluR-5, kainite sensitive glutamate receptor | 248 ± 23 | 359 ± 22 | 351 ± 12 | 0.0007 | None |
| | | Adhesion, Extracellular Matrix | | | | | |
| SEQ ID NO: 102 | E13541 | Cspg5, chondroitin sulfate proteoglycan 5 | 3938 ± 342 | 5112 ± 312 | 5980 ± 242 | 0.0003 | Both |
| SEQ ID NO: 103 | X83231 | PAIHC3, Pre-alpha-inhibitor, heavy chain 3 | 2586 ± 110 | 2974 ± 180 | 3460 ± 183 | 0.0038 | OMT |
| SEQ ID NO: 104 | AF097593 | Ca4, cadherin 2-type 1 (neuronal) | 615 ± 45 | 855 ± 61 | 881 ± 59 | 0.0049 | OMT |
| | | Myelin-Related Proteins | | | | | |
| SEQ ID NO: 105 | M55534 | Cryab, alpha crystalline polypeptide 2 | 2889 ± 155 | 4153 ± 196 | 4621 ± 238 | 0.0000 | Both |
| SEQ ID NO: 106 | D28111 | MOBP, myelin-associated oligodendrocytic basic protein | 13950 ± 386 | 15483 ± 633 | 18407 ± 909 | 0.0004 | Both |
| SEQ ID NO: 107 | X06554 | S-MAG, myelin-associated glycoprotein C-term | 5282 ± 258 | 5595 ± 140 | 6564 ± 326 | 0.0038 | Both |
| SEQ ID NO: 108 | S55427 | Pmp, peripheral myelin protein | 2458 ± 59 | 2856 ± 148 | 3080 ± 129 | 0.0051 | OMT |
| SEQ ID NO: 109 | M22357 | MAG, myelin-associated glycoprotein | 978 ± 163 | 1544 ± 190 | 2455 ± 332 | 0.0010 | SWM |

TABLE 1B-continued

ACGs and Genes Showing Highly Significant Age-Dependent Increases in Expression

| SEQ ID NO: | GenBank | Description | Young | Mid | Aged | ANOVA p | beh all |
|---|---|---|---|---|---|---|---|
| Lipid Metabolism/Transport ||||||||
| SEQ ID NO: 110 | X54096 | Lcat, Lecithin-cholesterol acyltransferase | 187 ± 35 | 298 ± 30 | 417 ± 38 | 0.0003 | Both |
| SEQ ID NO: 111 | S83279 | HSDIV, 17-beta-hydroxysterold dehydrogenase type IV | 630 ± 54 | 685 ± 91 | 928 ± 67 | 0.0182 | Both |
| SEQ ID NO: 112 | U37138 | Sts, Steroid sulfatase | 368 ± 74 | 521 ± 33 | 587 ± 35 | 0.0128 | OMT |
| SEQ ID NO: 113 | X55572 | Apod, Apolipoprotein D | 5875 ± 355 | 7281 ± 601 | 8343 ± 595 | 0.0133 | OMT |
| SEQ ID NO: 114 | L07736 | Cpt1a, Carnitine palmitoyltransferase 1 alpha (liver) | 599 ± 65 | 677 ± 59 | 854 ± 59 | 0.0192 | OMT |
| Amino Acid/Transmitter Metabolism ||||||||
| SEQ ID NO: 115 | J03481 | DHPR, Dihydropteridine reductase | 13260 ± 369 | 16897 ± 528 | 17432 ± 380 | 0.0000 | Both |
| SEQ ID NO: 116 | Z50144 | Kat2, kynurenine aminotransferase II | 106 ± 33 | 183 ± 19 | 240 ± 24 | 0.0040 | Both |
| SEQ ID NO: 117 | U07971 | Transamidinase, mitochondrial | 2897 ± 130 | 3311 ± 186 | 3644 ± 182 | 0.0183 | OMT |
| SEQ ID NO: 118 | M77694 | Fah, fumarylacetoacetate hydrolase | 847 ± 36 | 990 ± 49 | 1305 ± 98 | 0.0002 | SWM |
| Cytoskeletal, Vesicle Fusion ||||||||
| SEQ ID NO: 119 | X62952 | Vim, vimentin | 571 ± 100 | 998 ± 162 | 1346 ± 122 | 0.0016 | Both |
| SEQ ID NO: 120 | AA892333 | Tuba1, alpha-tubulin | −52 ± 83 | 117 ± 90 | 357 ± 79 | 0.0080 | Both |
| SEQ ID NO: 121 | U11760* | Vcp, valosin-containing protein | 4314 ± 234 | 5004 ± 333 | 5651 ± 278 | 0.0120 | Both |
| SEQ ID NO: 122 | U32498* | RSEC8, rat homolog of yeast sec8 | −11 ± 37 | 270 ± 81 | 232 ± 82 | 0.0236 | OMT |
| SEQ ID NO: 123 | AF083269* | P41-Arc, actin-related protein complex 1b | 406 ± 23 | 488 ± 49 | 626 ± 72 | 0.0249 | OMT |
| SEQ ID NO: 124 | AF028784 | GFAP, glial fibrillary acidic protein | 19860 ± 714 | 19731 ± 1002 | 23241 ± 1058 | 0.0217 | SWM |
| Transporters, Carriers ||||||||
| SEQ ID NO: 125 | M94918 | Hbb, beta hemoglobin | 6172 ± 737 | 8698 ± 646 | 13715 ± 1017 | 0.0000 | Both |
| SEQ ID NO: 126 | U31866 | Nclone10 | 3625 ± 302 | 5416 ± 561 | 7407 ± 511 | 0.0000 | Both |
| SEQ ID NO: 127 | D38380 | Tf, Transferrin | 11990 ± 679 | 16431 ± 707 | 19831 ± 1519 | 0.0001 | Both |
| SEQ ID NO: 128 | X56325 | Hba1, alpha 1 homoglobin | 14433 ± 611 | 17259 ± 959 | 23893 ± 1426 | 0.0000 | OMT |
| SEQ ID NO: 129 | AF008439 | Natural resistance-associated macrophage protein 2 | 69 ± 17 | 153 ± 19 | 152 ± 13 | 0.0018 | SWM |
| Growth, Biosynthesis, Maintenance ||||||||
| SEQ ID NO: 130 | AA799645 | FXYD domain-containing ion transport regulator 1 | 1680 ± 58 | 2025 ± 68 | 2457 ± 129 | 0.0000 | Both |
| SEQ ID NO: 131 | L03201 | Ctss, cathepsin S | 17087 ± 393 | 19066 ± 691 | 22376 ± 875 | 0.0001 | Both |
| SEQ ID NO: 132 | M27905 | Rpl21, Ribosomal protein L21 | 11279 ± 905 | 13999 ± 389 | 15557 ± 379 | 0.0001 | Both |
| SEQ ID NO: 133 | AA893493 | RPL26, Ribosomal protein L26 | 18442 ± 688 | 23043 ± 506 | 24252 ± 1162 | 0.0001 | Both |
| SEQ ID NO: 134 | X52619 | Rpl28, Ribosomal protein L28 | 13167 ± 323 | 13231 ± 310 | 14520 ± 228 | 0.0034 | Both |
| SEQ ID NO: 135 | X14181* | RPL18A, Ribosomal protein L18a | 8623 ± 430 | 10171 ± 389 | 11025 ± 602 | 0.0068 | Both |
| SEQ ID NO: 136 | M31076 | TNF-alpha, Transforming growth factor (alpha) | 139 ± 23 | 241 ± 43 | 295 ± 35 | 0.0167 | Both |
| SEQ ID NO: 137 | AI171462* | Cd24, CD24 antigen | 864 ± 69 | 1270 ± 86 | 1304 ± 101 | 0.0026 | OMT |
| SEQ ID NO: 138 | X68283 | Rpl29, Ribosomal protein L29 | 9705 ± 262 | 9500 ± 300 | 10807 ± 267 | 0.0050 | OMT |
| SEQ ID NO: 139 | X53504* | RPL12, Ribosomal protein L12 | 9877 ± 328 | 11398 ± 367 | 11719 ± 620 | 0.0241 | OMT |
| SEQ ID NO: 140 | U77829 | Gas-5, growth arrest homolog | 173 ± 15 | 228 ± 14 | 264 ± 20 | 0.0030 | SWM |
| SEQ ID NO: 141 | AI234146 | Csrp1, Cysteine rich protein 1 | 4436 ± 335 | 4925 ± 207 | 5451 ± 179 | 0.0243 | SWM |
| Protein Processing and Trafficking ||||||||
| SEQ ID NO: 142 | M32016 | Lamp2, lysosomal-associated membrane protein 2 | 759 ± 38 | 906 ± 36 | 1092 ± 74 | 0.0008 | Both |
| SEQ ID NO: 143 | E01534 | Rps15, Ribosomal protein S15 | 16577 ± 368 | 17202 ± 429 | 18363 ± 368 | 0.0116 | OMT |
| SEQ ID NO: 144 | AI028975 | AP-1, adaptor protein complex (beta 1) | 1077 ± 38 | 1163 ± 69 | 1317 ± 49 | 0.0158 | OMT |
| SEQ ID NO: 145 | AI175486 | Rps7, Ribosomal protein S7 | 5820 ± 448 | 6409 ± 312 | 7212 ± 208 | 0.0215 | OMT |
| SEQ ID NO: 146 | AF023621 | Sort1, sortilin | 414 ± 34 | 813 ± 143 | 812 ± 109 | 0.0247 | OMT |
| SEQ ID NO: 147 | AI230712 | Pace4, Subtilisin —like endoprotease | 281 ± 31 | 447 ± 49 | 570 ± 56 | 0.0010 | SWM |
| SEQ ID NO: 148 | AA891445* | Skd3, suppressor of $K^+$ transport defect 3 | 321 ± 24 | 440 ± 42 | 508 ± 37 | 0.0043 | SWM |
| SEQ ID NO: 149 | AF031430 | Stx7, Syntaxin 7 | 794 ± 133 | 1387 ± 188 | 1461 ± 122 | 0.0097 | SWM |
| SEQ ID NO: 150 | AA900516 | Pdi2, peptidyl arginine deiminase (type II) | 57 ± 42 | 314 ± 62 | 344 ± 51 | 0.0015 | None |

The analyses for TABLE 1B are as described for TABLE 1A.

Figure 5:
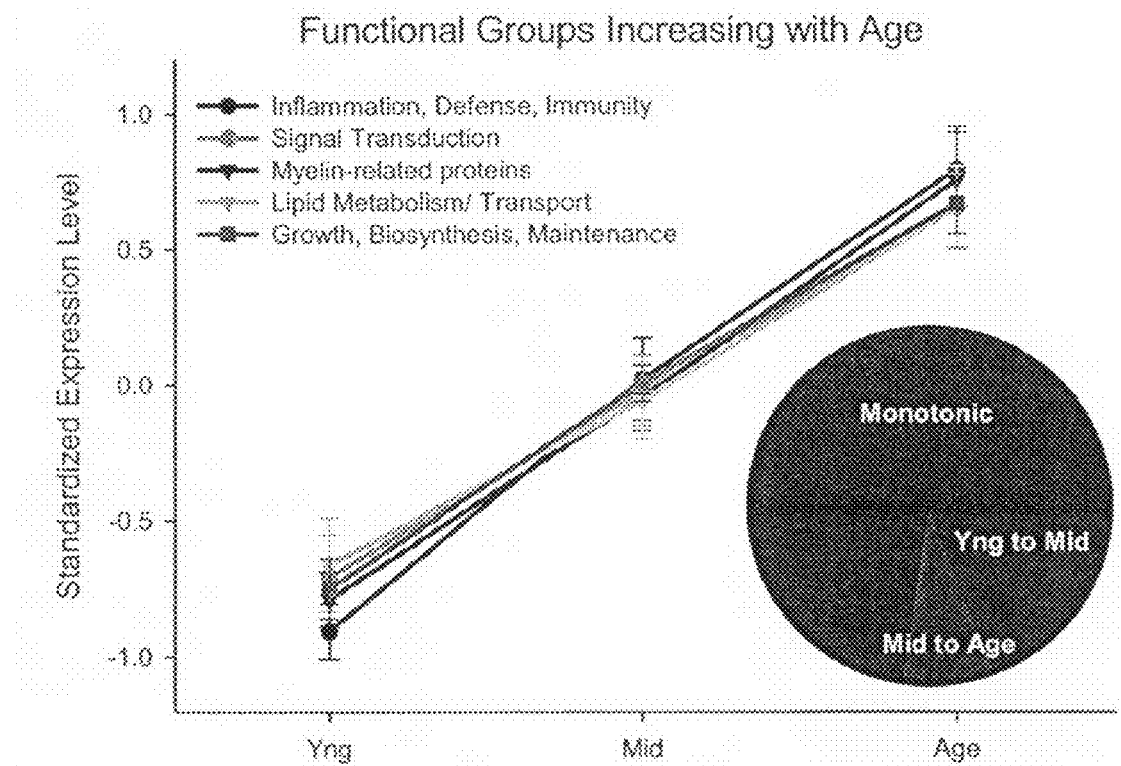
FIG. 5 is a line graph and pie chart insert showing functional categories and age course of genes increased with aging. Chronological patterns are shown for aging changes for five of the eleven functional categories of behaviorally-correlated upregulated genes (some categories were omitted to increase legibility and because their pattern of change with age was highly similar to that of categories already depicted). Calculations and nomenclature as in FIG. 4. Note that, in contrast to the majority of downregulated genes (FIG. 4), changes in upregulated categories did not tend to level off after mid-life but instead showed continuing change between mid-life and late-life (e.g., a monotonic pattern). Similar patterns were seen when all upregulated genes are considered (Pie-chart inset).

Upregulated Genes. Genes that were upregulated with aging and negatively correlated with behavior fit primarily into categories that appeared to reflect activated glial functions (FIGS. 3B and 5, TABLE 1B). Additionally, among the main unexpected findings was a widespread upregulation in the expression of genes encoding proteins for myelin synthesis and lipid turnover (TABLE 1B).

Lipid Metabolism. Multiple genes important for mitochondrial and cytosolic lipid β-oxidation (e.g., carnitine palmitoyltransferase, lecithin-cholesterol acyltransferase, etc.;

TABLE 1B), the primary pathway for free fatty acid (FFA) catabolism, were upregulated.

Increased Myelin Synthesis, Cholesterol Biogenesis and Vesicle Transport. Importantly for identifying the trigger mechanism for elevated lipid catabolism, the expression of many genes encoding myelin-related proteins or myelin-related transcription factors on the microarray was increased with aging (and several also were correlated with cognitive impairment) (TABLE 1B). These observations strongly suggest that a major increase in myelin synthesis programs developed with aging. This interpretation is also supported by the upregulation of multiple genes important in lipogenesis for cholesterol biosynthesis (Add 1/SREBP1), and the packaging/transport of cholesterol esters and other complex lipids (ApoD, LCAT, etc.) (TABLE 1B). Recent studies have shown that stimulation of myelin synthesis programs in oligodendrocytes is associated with induction of genes for both myelin proteins and lipogenic pathways (Nagarajan R et al., *Neuron* 30 355-68 (2001)).

Cyloskeleton/Vesicles. Moreover, expression of genes related to actin assembly, transport or fusion of packaged vesicles (actin related complex, rsec8, tubulin, and syntaxin 7) was increased (TABLE 1B). These molecules are associated with vesicle transport and fusion in neurons. In addition, however actin assembly proteins are also known to play a major role in myelin vesicle transport in oligodendrocytes (Madison D L et al., *J Neurochem* 72: 988-98 (1999)). Given the upregulation of myelin programs and the downregulation of synaptic plasticity genes, therefore, the age-dependent upregulation of genes linked to vesicle transport capacity seems more likely to be associated with enhanced myelin transport in oligodendrocytes. Further support for the view that extensive oligodendrocyte activation and/or synthesis occurs in hippocampal aging is provided by the observation that many genes that were upregulated with aging are preferentially expressed in oligodendrocytes (e.g., myelin proteins, FAH, PGD-S, etc.) (e.g., Labelle Y et al., *Biochim Biophys Acta* 1180: 250-6 (1993)).

Myelin also is normally degraded to free fatty acids through the endosomal-lysosomal pathway. Consistent with elevation of myelin degradation, we also found increased expression of Cathepsin S and other genes encoding lysosomal enzymes (TABLE 1B). Cathepsin S is particularly important in the processing of antigenic myelin fragments.

Amino Acids. In contrast to enzymes for glucogenic amino acids (TABLE 1A), expression was upregulated for multiple genes encoding enzymes related to the metabolism of the ketogenic/glucogenic amino acids, tyrosine, phenylalanine and tryptophan (e.g., DHPR, KAT, FAH, see, TABLE 1B). Catabolism of ketogenic amino acids yields either acetoacetate or one of its precursors (e.g., acetyl CoA), which can be used either for energy metabolism or lipogenesis. Upregulation of DHPR, which catalyzes the formation of a critical cofactor (tetrahydrobiopterin) for tyrosine and monoamine synthesis, and concomitant upregulation of MAO-B (TABLE 3), together suggest elevated metabolism of tyrosine and tryptophan via greater monoamine turnover.

Inflammation/Defense/Immunity. There was massive upregulation of expression of genes encoding MHC class I antigen presenting molecules, and numerous other inflammatory/immune proteins (TABLE 1B). Genes in the inflammation category exhibited some of the most robust monotonic changes with aging seen in our results using the method of the invention (e.g., most were significant at the p<0.001 criterion with 0.025 FDR) (TABLE 1B). Moreover, most were inversely correlated with cognitive function (FIG. 3B).

Consistent with evidence of a role for oxidative stress in brain aging (Carney J M et al., *Proc Natl Acad Sci USA* 88: 3633-6 (1991), Hensley K et al., *Ann N Y Acad Sci* 786: 120-34 (1996), Bickford P C et al., *Brain Res* 866: 211-7 (2000), Lee C K, et al. *Nat Genet* 25: 294-7 (2000), Jiang C H et al., *Proc Natl Acad Sci USA* 98: 1930-4 (2001)), we also found increased expression for molecules important in defense against oxidative stress (GST, GSTa1) (TABLE 1B). One potentially key new finding here, as noted above, was that DHPR was upregulated with aging and correlated with cognitive decline (TABLE 1B). Its product, tetrahydrobiopterin, is also an essential cofactor for nitric oxide synthase (Boyhan A, et al. *Biochem J* 323 (Pt 1) 131-9 (1997)). Because oxyradicals formed from nitric oxide appear to play a major role in inflammatory neuronal damage (Bal-Price A & Brown G C, *J Neurosci* 21: 6480-91 (2001), Calingasan N Y & Gibson G E, *Brain Res* 885: 62-9 (2000)), this may be an important pathway through which the deleterious effects of inflammation are mediated in brain aging.

Glial Markers. Astrocyte reactivity and astrocyte markers are also well recognized to increase in the aged rodent and human hippocampus (Landfield P W et al., *Science* 214: 581-4 (1981), Landfield P W et al., *J Neurobiol* 23: 1247-60 (1992), Nichols N R et al., *Neurobiol Aging* 14: 421-9 (1993), Finch C E & Longo V D, *Neuroinflammatory Mechanisms in Alzheinier's Disease. Basic and Clinical Research*, 237-256 (2001)) and the present data confirm extensive upregulation of genes (Finch C E & Tanzi R E *Science* 278: 407-11 (1997)) for glial markers (e.g., vimentin, GFAP-cytoskeleton category, TABLE 1B). In addition, we extended those observations to show that genes for proteoglycans (TABLE 1B) and other extracellular proteins (e.g., fibronectin) that are components of astroglial scars also were upregulated. These changes may reflect astroglial-mediated reorganization of the extracellular matrix, a process known to be unfavorable for axonal remodeling.

Signal Transduction. Several genes in calcium regulating and G-protein-coupled signaling pathways were also identified (TABLE 1B). In particular, S100A1, which modulated $Ca^{2+}$-induced $Ca^{2+}$ release, and PI 4-kinase, which acts to produce IP3 were upregulated. Several other S100-related genes (e.g., S100A4 and P9K2; TABLE 3) were also upregulated with aging but failed to meet the strict criteria set forth herein (FIG. 2).

Biosynthesis. Concomitantly, many ribosomal (growth) and protein processing genes were upregulated (TABLE 1B). The upregulated changes reflect increased protein synthesis, turnover and phagocytosis associated with strongly elevated biosynthetic processes in glial compartments (e.g., elevated myelin, MHC, proteoglycan synthesis).

Orchestrating Factors. Our data show that a number of transcriptional regulators and cytokines, including KZF-1, Roaz and members of the NFI family (TABLE 1B) were upregulated and therefore, may be strong candidates for coordinating factors. Under some conditions, several of these factors function as negative transcriptional regulators.

Relationship to Fold Change. The large majority of microarray analyses to date have used fold-change criteria to detect changes in expression. In addition to providing little basis for statistical assessment (e.g., Miller R A, et al. *J Gerontol A Biol Sci Med Sci* 56 B52-7 (2001)), however, fold-change criteria are relative insensitive. Among the 139 ACGs, most exhibited group mean fold changes between the Young and Aged groups of less than 1.5 (92), a few showed fold changes between 1.5 and 2.0 (26), and only a handful of genes exceeded 2-fold-change (20) (TABLES 1A and B). Thus, few of our results using the method of the invention would have been detected in the great majority of prior microarray studies, in which 1.7 to 2-fold change cutoffs are commonly used as minimum criteria for identifying differences, and many changes are reported in the 3-4 fold range. Further, the rank order correlation between group mean fold-change and p values on the ANOVA for all aging-significant genes, although significant, was modest according to Spearman's correlation test (Spearman's r=0.45, p<0.001). Armitage P & Berry G, *Statistical Methods in Medical Research*, $2^{nd}$ Edn., 200-205 (1987). This indicates that fold-change accounted for only ~20% of the variance (r2) in the degree of statistical significance on the ANOVA. Some of our results detected with the enhanced sensitivity of statistical analysis were extremely subtle (e.g., 1.1 fold for the L28 and L29 ribosomal proteins, TABLE 1B). Despite this enhanced sensitivity, however, numerous false negatives were still undoubtedly present in our data set.

Figure 4:
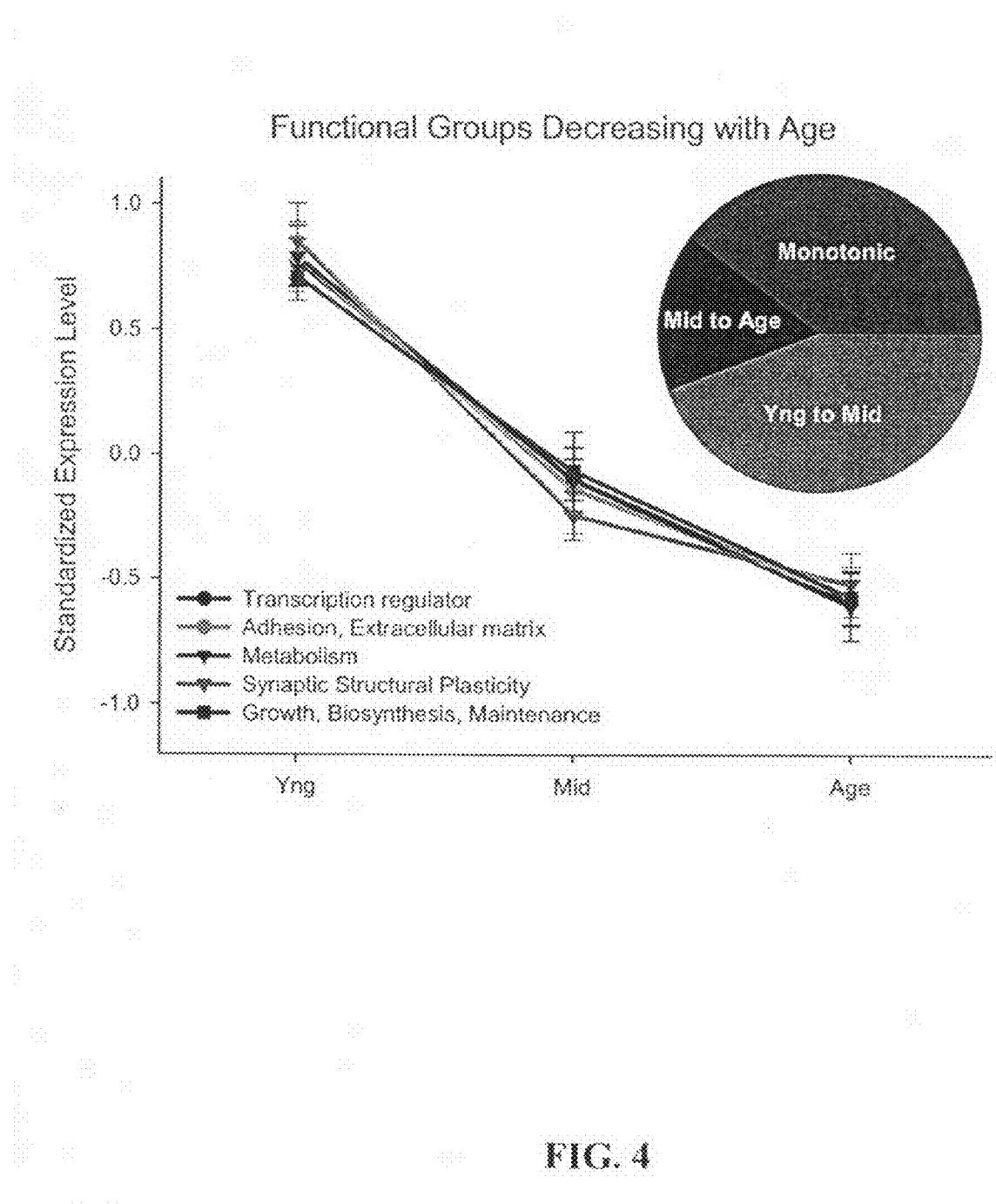
FIG. 4 is a line graph and pie chart insert showing functional categories and age course of genes decreased with aging. Chronological patterns are shown for aging changes for five of the eight functional categories (some categories were omitted to improve legibility and because they were highly similar to the ones already depicted). Each gene's expression was normalized prior to calculating category mean values. Note that most down-regulated categories exhibited $\geq 50\%$ of mean changes by the Mid-Aged point, and showed relatively less change between the Mid-Aged and Aged animals. No category showed a predominantly Mid-to-Aged pattern of change. The pie-chart insert shows proportion of genes that followed each of the three possible routes to decreased expression with aging.

Age Course of Gene Expression Changes. Using a design with three age groups enabled us to classify genes and categories according to their general patterns of age dependence of change (FIGS. 4 and 5). Genes were classified by whether 75% of the maximal change occurred between the Young and Mid-Aged groups (Yng to Mid), the Mid-Aged and Aged groups (Mid to Aged), or the Young and Aged groups (monotonic).

Almost all categories comprising downregulated and cognitively correlated genes (TABLE 1A), exhibited their greatest change between the Young and Mid-Aged points, and many did not show much additional downregulation between the Mid-Aged and Aged groups (FIG. 4). This was also true for the entire population of genes whose expression decreased with aging at p<0.025 (pie-chart inset, FIG. 4). Conversely, by far the largest fraction of functional categories of upregulated genes showed a monotonic age course of change that also began between the Young and Mid-Aged points but, in addition, continued between the Mid-Aged and Aged points (FIG. 5). However, the Cytoskeletal and Transcriptional Regulator categories contained significant numbers of exceptions that exhibited >75% of their change between the Young and Mid-Aged groups (TABLE 1B). Additionally, among all genes that showed significant upregulation with aging, the majority fit the monotonic classification (pie-chart inset, FIG. 5). Only a few scattered genes showed a predominantly Mid to Aged change pattern (e.g., FIGS. 4 and 5 pie-charts).

Strongest Correlations of Pathways with Memory Performance. To determine which pathways were most closely correlated with memory performance, we calculated the percentage of genes in each of our categories that were correlated significantly (at p<0.025) with both memory tests. We reasoned that each test measures aspects of memory but each test also has its own error sources and confounding contributions from non-cognitive performance factors. Therefore, genes that correlated with both tasks seem more likely to be associated with cognitive processes.

Because memory performance changed most between the Mid-Aged and Aged groups (FIG. 1), whereas downregulated genes changed little (FIG. 4) and upregulated genes continued to increase (FIG. 5) between those groups, the pattern of age course changes relative to cognitive performance was more similar for upregulated than for down-regulated genes. Not surprisingly, therefore, more upregulated (52%) than downregulated (44%) genes were correlated with performance on both tasks. Three categories of downregulated genes had 50% or higher both-task correlations: Adhesion and extracellular matrix (3/5), Metabolism (8/10), and Protein processing and trafficking (3/5). Whereas seven categories of upregulated genes had 50% or higher both-task correlations: Signaling (5/7), Inflammation (14/20), Cytoskeleton/Vesicle (3/6), Myelin related proteins (3/5), Amino acid/transmitter metabolism (2/4), Transporters and carriers (3/5), and Growth, biosynthesis, maintenance (7/12). In the Signaling category, moreover, genes involved in intracellular $Ca^{2+}$ release, S100A1 and PI3-K (TABLE 1B), were correlated with both tasks.

Another way to examine closeness of correlation specifically with memory impairment is to correlate gene expression with performance only in the aged group. This correlation focuses on variation in the performance of aged animals and removes the overall age course pattern from contributing to the correlation with impairment. This correlation is independent of the ANOVA for aging effects and an FDR also can be calculated. Consequently, we tested each of the 139 primary aging- and behaviorally-related genes for correlation with 24 hr memory performance on the OMT in the aged group. The OMT was selected over the SWM for this test as it had the greater dispersion of performance needed for correlation analysis. The correlation tests in the aged group (n=10) of course had considerably less power than across all three groups (n=29) and the criterion for significance was set at p<0.025.

Only 3 (4.9%) of the downregulated ACGs, but 10 (12.2%) of the upregulated ACGs were correlated with Aged group performance on the OMT. The FDR for these genes was 0.28. Two of the 3 downregulated ACGs were accounted for by the Synaptic Structural Plasticity category (Fez-1, agrin). For upregulated genes, two of the 10 ACGs were from Inflammation (MHC and CD59 antigen), three from Cytoskeleton/Vesicle category (Vcp, rsec8 and p41-Arc), and three from Growth/Biosynthesis (2 ribosomal proteins and CD24 antigen). No other category had more than one, including Transcription (NF1-A) and Protein processing and trafficking (Skd3).

Thus, by the criterion of correlation on both tasks, the upregulated categories of Inflammation/immune, signaling (particularly $Ca^{2+}$ signaling), Cytoskeleton/Vesicle and Amino Acid Metabolism were ranked most highly. By the criterion of correlation in the aged group only, the upregulated categories of Cytoskeleton/Vesicle (3/6), Biosynthesis (3/12) and Inflammation (2/20), and the downregulated category of Synaptic Plasticity (2/7) were ranked most highly.

Benefits of the Invention. One of the major problems associated with developing treatments for aging-dependent functional decline is the lack of good genomic biomarkers or targets of brain aging needed for evaluating the efficacy of different treatments. Our ACGs, therefore, could serve as excellent biomarkers of cognitive aging. Using microarrays constructed to contain oligonucleotide sequences specific for hybridization with and measurement of mRNAs of the identified ACGs, laboratory animals could be assessed for degree of cognitive aging before, during and after treatment with a compound. Treatments that slowed or reversed the ACG profile during aging might be highly promising for development as new therapeutic approaches. Further, treatments that slowed or reversed expression profiles of particular genes in our panel of biomarkers might reveal which specific genes among the subset of ACGs are most critical for the age-dependent functional decline and, therefore, would suggest genes and gene products that should be targeted with high priority for development of therapeutic interventions. The same approach could be applied using our panel of unique brain aging genes that are not specifically clustered with cognition related genes, to evaluate and develop new therapies and compounds for treatment of brain aging in general.

The panel of ACGs identified here can be used on a microarray to perform diagnostic tests. Subjects suspected of having accelerated brain aging or early age-related neurodegenerative disease could provide a small brain biopsy sample for testing by microarray. This could then determine the subject's suitability for pharmacologic intervention.

Based on the gene lists described above, investigators can develop new drugs or treatments aimed at altering the activity of one or more genes in the lists, or products encoded by those genes, or targets of the products, with the goal of counteracting age-related cognitive impairment or brain aging in general.

A smaller subset of ACGs, specifically linked to some process or system (e.g., to inflammation, mitochondrial function, or lipid metabolism, etc.), could be used in a microarray to test efficacy of a new compound targeted to slowing or reversing aging and cognitive changes dependent on that set of genes or gene-impacted systems, either in experimental tests to develop new compounds, or as diagnostic or therapeutic guides.

Relevance to Human Brain Aging and Alzheimer's Disease. Normal human brain aging is associated with memory dysfunction and appears to set the stage for Alzheimer's disease and other age-related neurodegenerative conditions. It also shares many features with animal models of aging. Landfield P W et al., *J Neurobiol* 23: 1247-1260 (1992). Thus, many of the memory-correlated gene expression profiles seen here in rats may have implications for genomic mechanisms of human brain aging and/or Alzheimer's disease. This view is supported by several parallels between processes identified here and those seen in human aging or Alzheimer's disease. For example, myelin abnormalities are also found extensively in normal brain aging in humans (leukoaraiosis). These white matter changes in humans are also correlated with cognitive dysfunction and become more severe in disease states. Further, cerebral metabolism begins to decline by mid-life in humans, much as it apparently does in rats (FIG. 4). Of particular note in light of our findings on oxidative phosphorylation and myelin turnover, mitochondrial diseases in humans also can result directly in demyelination.

It is interesting, in view of the apparently altered lipid metabolism seen here, that activity of the cholesterol ester synthesizing enzyme acyl CoA:cholesterol acyltransferase (ACAT) is elevated in Alzheimer's disease and appears directly coupled to amyloid production. ACAT has lipogenic functions somewhat similar to those of LCAT, which was also upregulated here (TABLE 1A). Moreover, activity of glycerol-3-phosphate dehydrogenase (GPDH) is elevated in association with abnormal glucose metabolism in brains of patients with Down's syndrome. The gene encoding this glycolytic enzyme was also upregulated here (TABLE 1A). Other processes found in human aging or Alzheimer's disease brain for which we found corollaries in gene expression include, as noted, inflammation, oxidative stress and elevated KatII (kynurenine aminotransferase 2), among others. Thus, if these parallels depend, at least in part, on similar mechanisms, our results show that widespread genomic regulatory changes would reasonably be expected to contribute to altered cerebral metabolism, lipid synthesis, neural activity and myelination in human brain aging as well.

Figure 6:
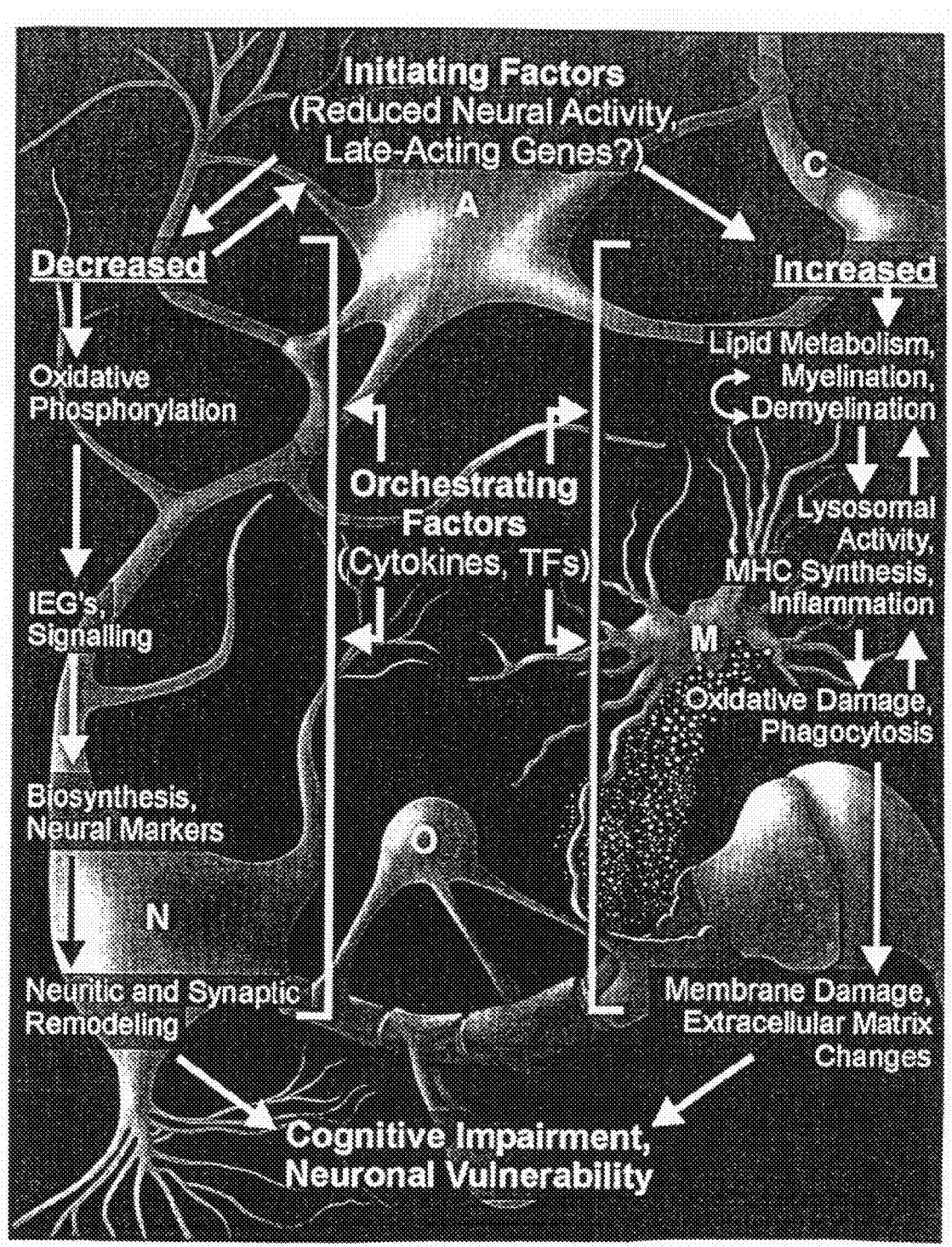
FIG. 6 is a micrograph showing a model of parallel neuronal and glial cascades leading to functional impairment. Early in mid-life, initiating factors (e.g., reduced neuronal activity, onset of late-acting gene expression) induce down regulation of neuronal (N) oxidative phosphorylation triggering a cascade of impaired IEG signalling, biosynthetic potential, and critically, decreased capacity for neurite remodeling and synaptogenesis. In parallel, enhanced lipid metabolism and demyelination are triggered in oligodendrocytes (O) by altered energy metabolism or neural activity. In turn, astrocytes (A) hypertrophy and increase glycolysis of the glucose taken up by astrocytic endfeet on capillaries (C). Simultaneously, phagocytosis of myelin fragments triggers oxidative damage and inflammatory responses in microglia (M). Eventually, the combined effects of reduced synaptic remodeling, decreased activity and axon conduction, altered extracellular matrix and expanding inflammation result in cognitive failure and neuronal vulnerability.

Implications for a New Hypothesis of Brain Aging. Based on the functional implications of our results, as discussed above, we provide a new working model of brain aging (FIG. 6). Early in adult life (i.e., before mid-life) a series of brain changes begin, perhaps initiated by new expression of genes that exert deleterious late-life actions (e.g., "late genes") (Finch C E, *Longevity, Senescence and the Genome*, 37-42 (Univ. Chicago Press, Chicago, 1990); Austad, S N, *Why We Age. What Science Is Discovering about the Body's Journey Through Life* (Indianapolis, Wiley, 1999)) or by catabolic hormonal processes (e.g., glucocorticoids, Porter N M & Landfield P W, *Nature Neurosci* 1: 3-4 (1998)). These changes include reduced neuronal activity and induce a subtle shift from anabolic to catabolic metabolism in neurons. In neurons, the reduced anabolic capacity leads to diminished capacity for protein biosynthesis and, in particular, for activity-dependent neurite remodeling and synaptogenesis. Concomitantly, an increase in degradation of myelin and lipids begins, perhaps triggered by reduced neural activity, or reduced oxidative phosphorylation and/or demand for an alternative energy source, or by an immune process similar to multiple sclerosis, among other possibilities. The degenerating myelin fragments are endocytosed in microglia and astrocytes, degraded by lysosomes and packaged into antigen-presenting MHC molecules. This in turn activates orchestrating cytokines and transcription factors that trigger an inflammatory reaction in the glia and possibly, in macrophages. The inflammation further accelerates the phagocytosis and degradation of myelin. As astrocytes hypertrophy, they increase glycolytic metabolism and synthesize "glial scar" proteins (e.g., fibronectins, proteoglycans) that alter the extracellular matrix. In oligodendrocytes, lipogenic and myelin synthesis programs are activated in response to the ongoing demyelination and/or altered signaling pathways. In turn, remyelination may increase demand for lipid substrate and thereby also accelerate demyelination. Thus, positive feedback cycles between demyelination and myelination and/or between demyelination and inflammation, among other processes, might develop and further drive cellular dyshomeostasis. Eventually, the reduced synaptogenic capacity unfavorable extracellular matrix and degradative inflammatory processes result in failure of cognitive processing. Additionally, the ongoing catabolic processes erode neuronal membranes and cytoskeletons, increase protein aggregation and enhance vulnerability to neurodegenerative disease. Accordingly, our results, in conjunction with this working model, point directly to potentially useful therapeutic interventions and should, therefore, facilitate the design of such future therapeutics.

The details of one or more embodiments of the invention are set forth in the accompanying description above. Although any methods and materials similar or equivalent to those described herein can be used in the practice or testing of the present invention, the preferred methods and materials are now described. Other features, objects, and advantages of the invention will be apparent from the description and from the claims. In the specification and the appended claims, the singular forms include plural referents unless the context clearly dictates otherwise. Unless defined otherwise, all technical and scientific terms used herein have the same meaning as commonly understood by one of ordinary skill in the art to which this invention belongs. All patents and publications cited in this specification are incorporated by reference.

The following EXAMPLES are presented in order to more fully illustrate the preferred embodiments of the invention. These examples should in no way be construed as limiting the scope of the invention, as defined by the appended claims.

EXAMPLE 1

Behavioral Results

Thirty animals in three age groups (n=10/group) were trained sequentially on two tasks, first in the Morris spatial water maze (SWM) and then in the object memory task (OMT). Male Fischer 344 rats aged 4 months (Young, n=10), 13 months (Mid-Aged, n=10) and 24 months (Aged, n=10) were used. Overall, the training/testing lasted seven days, and hippocampal tissue was collected 24 hr later. Training or testing occurred on each day except for the $2^{nd}$ and $3^{rd}$ days of the seven-day sequence.

Methods used here for cognition assessment in the Morris Spatial Water Maze (SWM), a task sensitive to both hippocampal function and aging, have been described previously Norris C M & Foster T C, Neurobiol Learn Mem 71, 194-206 (1999). Briefly, rats were trained in a black tank, 1.7 M in diameter, filled with water (27±2° C.). Behavioral data were acquired with a Columbus Instruments tracking system. After habituation to the pool, animals were given cue training with a visible platform (five blocks of three trials, maximum of 60 sec/trial, 20 sec intertrial interval and a 15 min interval between blocks). Rats remained in home cages under warm air after each block. Cue training was massed into a single day and the criterion for learning was finding the platform on 4 of the last 6 trials. For all animals that met this criterion, spatial discrimination training was initiated three days later in which the escape platform was hidden beneath the water but remained in the same location relative to the distal cues in the room. Fifteen min following the end of spatial training, a 1-min duration free-swim probe trial with the platform absent was administered, during which crossings over the former platform site (platform crossings) were recorded to test acquisition, followed by a refresher training block. Retention for platform location was again tested 24-hr later using a second 1-min free-swim probe trial.

During cue training in the SWM, all animals were able to locate the visible escape platform according to our criteria and therefore, were trained on the hidden platform spatial task. During acquisition, Aged animals performed more poorly (longer latencies) than Mid-Aged or Young. In addition, an aging-dependent decrease in 24 hr retention, measured by platform crossings (1-way ANOVA, $p<0.05$), was observed on the retention probe trial (FIG. 1A). Post hoc analysis indicated that Young and Mid-Aged animals exhibited more platform crossings relative to Aged animals, but did not differ from each other.

Methods used here for cognition assessment in the object memory task OMT) have been described previously by Ennaceur A & Delacour J, Behav Brain Res 31: 47-59. (1988). The object memory task (OMT) is also both sensitive to hippocampal function and affected by aging but is less dependent on physical strength and endurance. On the afternoon of the final spatial maze probe trial, animals were administered a habituation session (15-min) in the empty mesh cage to be used for the OMT (63.5 cm×63.5 cm). OMT training began 24 hr after habituation and consisted of a 15-min acquisition session during which two 3-dimensional objects were placed at opposite sides of the cage, followed by two 15-min retention test sessions at 1 and 24 hr posttraining. During the acquisition session, the cage contained two sample objects (A and B) and the time spent actively exploring each object was recorded. After 1 hr, the rat was reintroduced into the cage and the time spent exploring a novel object, C, relative to the familiar object, B, was recorded. On the 24 hr test, familiar object A was reintroduced and object B was replaced by a second novel object, D. Objects were randomized across individuals and timed measures of exploration were used to calculate a memory index (MI) as follows: MI=(N−F)/T, where N is time spent exploring the novel object, F is time spent exploring the familiar object, and T is total time spent exploring the two objects. More time spent exploring the novel object (higher MI) is considered to reflect greater memory retention for the familiar object.

In the OMT, Aged animals performed as well as Young or Mid-Aged on the 1 hr retention test (not shown), but there was a significant age-related decline in recall (1-way ANOVA, $p<0.001$, for the main effect of age) on the 24 hr test (FIG. 1B). At 24 hr, Young and Mid-Aged groups were significantly different from the Aged group, but not from one another (Young vs. Aged: $p<0.001$; Mid-Aged vs. Aged: $p<0.05$; Young vs. Mid-Aged: N.S., Tukey's post-hoc test; Armitage P & Berry G, *Statistical Methods in Medical Research*, $2^{nd}$ *Edn.*, 200-205 (1987)).

EXAMPLE 2

Gene Microarray Chip Results

Microarray analyses were performed on hippocampal CA1 tissues from each of the same behaviorally characterized 30 animals (one chip per animal), but one chip was lost for technical reasons, leaving a data set of 29 microarrays (Young=9, Mid-Aged=10, Aged=10). For tissue preparation, twenty-four hours after completion of the OMT testing, animals were anesthetized with $CO_2$ gas and decapitated. The brains were rapidly removed and immersed in ice-cold, oxygenated artificial cerebrospinal fluid consisting of (in mM): 124 NaCl, 2 KCl, 1.25 $KH_2PO_4$, 2 $MgSO_4$, 0.5 $CaCl_2$, 26 $NaHCO_3$, and 10 dextrose. Hippocampi were removed and the CA1 region from one hippocampus per animal were dissected by hand under a stereomicroscope. The CA1 tissue block from each animal was placed in a microcentrifuge tube and flash frozen in dry ice for RNA isolation.

For RNA isolation, total RNA was isolated using the TRIzol reagent and following the manufacturer's RNA isolation protocol (Gibco BRL, #15596). One ml of TRIzol solution was added to each tube containing the frozen tissue block and the tissue was homogenized by 10 passages through an 18½ G syringe needle. After centrifugation, the RNA was precipitated from the aqueous layer, washed and redissolved in RNase-free water. RNA concentration and the integrity of RNA were assessed by spectophotometry and gel electrophoresis. The RNA samples were stored at −80° C.

Gene expression analyses were performed using the Affymetrix GeneChip System. The labeling of RNA samples, rat GeneChip (RG-U34A) hybridization and array scanning were carried out according to the Affymetrix GeneChip Expression Analysis Manual (r.4.0, 2000). Each animal's CA1 RNA was processed and run on a separate rat gene chip. Briefly, an average yield of 40 μg biotin-labeled cRNA target was obtained from 5 μg of total RNA from each CA1 sample, of which 20 ug cRNA was applied to one chip. The hybridization was run overnight in a rotating oven (Affymetrix) at 45° C. The chips were then washed and stained on a fluidics station (Affymetrix) and scanned at a resolution of 3 μm in a confocal scanner (Agilent Affymetrix GeneArray Scanner).

Each U34A rat chip (Affymetrix, Santa Clara, Calif.) contained 8,799 transcript probe sets (gene representations). Although the measured signal intensity for a transcript probe set (Methods) reflects mRNA content, it is referred to here as "gene expression". However, it is well recognized that mRNA stability and other factors in addition to gene transcription can affect mRNA content.

We used the microarray suite (MAS 4.0) software (Affymetrix) to calculate the overall noise of the image (the amount of variation around the mean intensity, Qraw) for each array. Overall noise was highly similar across arrays in all 3 age groups (Young: 21.81±1.55; Mid Aged: 21.25±2.24; Aged: 20.66±2.06, N.S.). "All probe set scaling" was used to set overall intensities of different arrays to an arbitrary target central intensity of 1500. Thus, the average intensity of each array was adjusted to the 1500 value using a scaling factor (SF). There was no significant difference in SF across ages (Young: 1.58±0.14; Mid Aged: 1.46±0.20; Aged: 1.63±0.16, N.S.).

The algorithm used to determine Presence/Absence is listed in the Microarray Suite 4.0 Manual and is the basis upon which a particular transcript is determined to be reliably detectable by a given probe set. Average difference scores, the average of the difference in expression intensity (ADEI) of each probe pair within a probe set, formed the basis for determining expression (relative abundance) of transcripts, and throughout the text the term "expression level" refers to the ADEI score. When comparing across appropriately normalized arrays, the larger the ADEI score, the greater the relative expression for that particular message. However, ADEI scores are not comparable for relative expression levels among different messages on the same chip, as there are several other factors that can confound such an assessment (e.g., p. 356, Affymetrix Microarray Suite 4.0 User's Guide).

The Presence/Absence calls and Average Difference scores for all probe sets on all 29 arrays were then copied from the MAS pivot table to an Excel 9.0 (Microsoft, SR-1) workbook. From within Excel, the following data manipulations were performed.

Min-Max. For the purposes of filtering (FIG. 2), each probe set was normalized according to the formula:

$$x = \frac{x - \overline{X}\min}{X\max - X\min},$$

where x is ADEI score, $\overline{X}_{min}$ is the mean for the age group with the lowest ADEI score, and $\overline{X}_{max}$ is the mean for the age group with the largest ADEI score. Thus, normalized mean values varied between 0 (lowest) and 1 (highest) for each probe set.

Standardization (Z-score): For the purpose of obtaining the mathematical means within functional categories and graphing, the data was normalized using the Z-score method:

$$z = \frac{x - \overline{X}}{SD(x)},$$

where $\overline{X}$ is the mean, and $SD(x)$ is the standard deviation of ADEI across all age groups for an individual probe set.

Statistical Analysis. All statistical tests were performed using a combination Excel (Microsoft, version 9, SR-1) and Sigma Stat (SPSS, version 2).

EXAMPLE 3

Multi-Step Gene Identification Algorithm

The analytic algorithm of the invention, which addresses the bioinformatics issues noted above, comprise three main steps aimed first, at reducing the number of comparisons (to manage type I error), second, at reliably detecting modest aging differences with global statistical analyses (by ANOVA), and third, at identifying aging-related expression changes that were quantitatively correlated with cognitive function (by Pearson's test; Armitage P & Berry G *Statistical Methods in Medical Research*, $2^{nd}$ Edn., 200-205 (1987)) (see, FIG. 2).

Multiple Comparison Reduction Step. The expected false positives in a series of multiple comparisons (false positive rate) are predicted to be a percentage of the total statistical comparisons to be made, as defined by the p-value (i.e., tests at $p<0.05$ will on average generate 5% false positives). Accordingly, the absolute numbers of expected false positives can be decreased simply by reducing the total transcript sets that are tested in a microarray analysis. This can be done by deleting all transcripts identified a priori as not likely to be relevant to the specific interests of the analysis.

Using this step of the method, we reduced the total transcripts to be tested in three phases. In the first phase, we deleted quality control oligonucleotide sets ("control", n=60) and all gene transcripts (probe sets) rated "absent" by our criteria. As used in this specification, the term "quality control oligonucleotides" are those oligonucleotides and polypeptides used to test for the appropriate behavior of the technological system, rather than to measure expression levels of biological interest.

Of the original 8,799 sets, 4,118 gene transcript sets were removed at this stage, leaving 4,681 transcript sets that were called "present" for further consideration (FIG. 2, step 1a). In the second phase, we deleted all "present" transcript sets representing "expressed sequence tags" (ESTs), which have not yet been clearly linked to known genes (FIG. 2, step 1b). There were 1,213 such ESTs rated "present" that we filtered out in this phase, leaving 3,468 transcript sets for further consideration. The third reduction phase was based on our interest in persistent aging-dependent changes reflected in substantial differences between the youngest and oldest groups. We further decreased the total transcript sets to be tested by deleting sets in which the difference between the Young and the Aged group did not comprise at least 75% of the maximum normalized difference among groups (i.e., in which age-related changes from the Young baseline values were maximal in the Mid-Aged group, but then reversed substantially (>25%) in the Aged group, possibly because of random, compensatory or developmental factors). There were 1,483 sets removed by this criterion, retaining 1,985 probe sets of the original 8,799 for formal statistical testing (FIG. 2; step 2). If the original 8,799 sets had been tested at the p<0.025 alpha level, ~420 false positives would have been expected. However, by reducing the total number of sets to be tested for statistical significance (at p<0.025), we reduced the absolute numbers of false positives expected from multiple tests, to ~50 (5% of 1985).

Group Statistical Testing Step (ANOVA). In this second main step of the algorithm, each of the remaining 1,985 transcript sets was tested by 1-way ANOVA for a significant effect of aging (at $p \leq 0.025$) across the 3 age groups (n=9–10/group). Of the 1,985 tested sets, 233 were found to change significantly with aging (observed total positives). As noted, at p<0.025, approximately 2.5% (~50) of the 1,985 tested should be significant by chance alone (expected false positives). In order to estimate the proportion of false discoveries anticipated among our 233 observed positives (i.e., the fraction of observed positives expected to be false), we used the expected false positive value to calculate the false discovery rate (FDR) (Benjamini et al., *Behav Brain Res* 125: 279-284 (2001)). For any multiple comparison, the false discovery rate provides an empirical estimate of the anticipated chance error rate among all positives detected. It is partly analogous to the p value of statistical tests, in that the false discovery rate yields the probability that any positive found at the alpha level used (in this case p<0.025) is positive by chance alone.

For the ANOVA-positive results, the FDR was 50/233=0.21, indicating that up to 21% of the observed positives might be positive by chance alone or, that any one positive had a 21% chance of being a false positive.

In addition, we examined the FDR obtained using two other ANOVA p-value levels, p<0.01 and p<0.001. At the p<0.01, ~20 genes should be found positive by chance alone among the 1,983 transcripts tested. A total of 145 total positives were observed, yielding an FDR of 20/145=0.14. At p<0.001 only 2 false positives are expected in 1,983 tests, and 70 total positives were found. This yields a FDR of 2/70=0.03. The latter, in particular, compares highly favorably with the 0.05 alpha level conventionally accepted for statistical significance in univariate analyses.

However, as noted, additional confidence and validation is gained in microarray analyses when similar patterns of regulation are found among multiple functionally similar genes (Prolla et al., *J Gerontol A Biol Sci Med Sci* 56: B327-330 (2001)). This is because such genes are not necessarily independent and their co-regulation can provide added cross-validation (e.g., Mirnics et al., *Neuron* 28: 53-67 (2000); Prolla et al., *J Gerontol A Biol Sci Med Sci* 56: B327-330 (2001)). Consequently, in many cases, confidence advantages can be gained by relaxing p-value criteria in order to expand the numbers of genes included in functional categories. Mirnics K, *Nat Rev Neurosci* 2: 444-447 (2001). Further, relaxing stringency of the p-value reduces the likelihood of type II error (false negatives). Based on these rationales, we used the set of 233 genes obtained at the less stringent $p \leq 0.025$ alpha level (rather than the set of 70 at $p \leq 0.001$) for the next main step of our algorithm, the behavioral correlation analysis (FIG. 2, step 3a).

Cognitive Performance Correlation Step (Pearson's Test). In this step we identify a specific subset of the 233 aging-significant (by ANOVA) genes that was also correlated with memory performance in both the OMT and SWM. We tested each of the 233 ANOVA-significant genes across animals for statistical correlation between that gene's expression value and behavioral scores (with Pearson's test).

Figure 3:
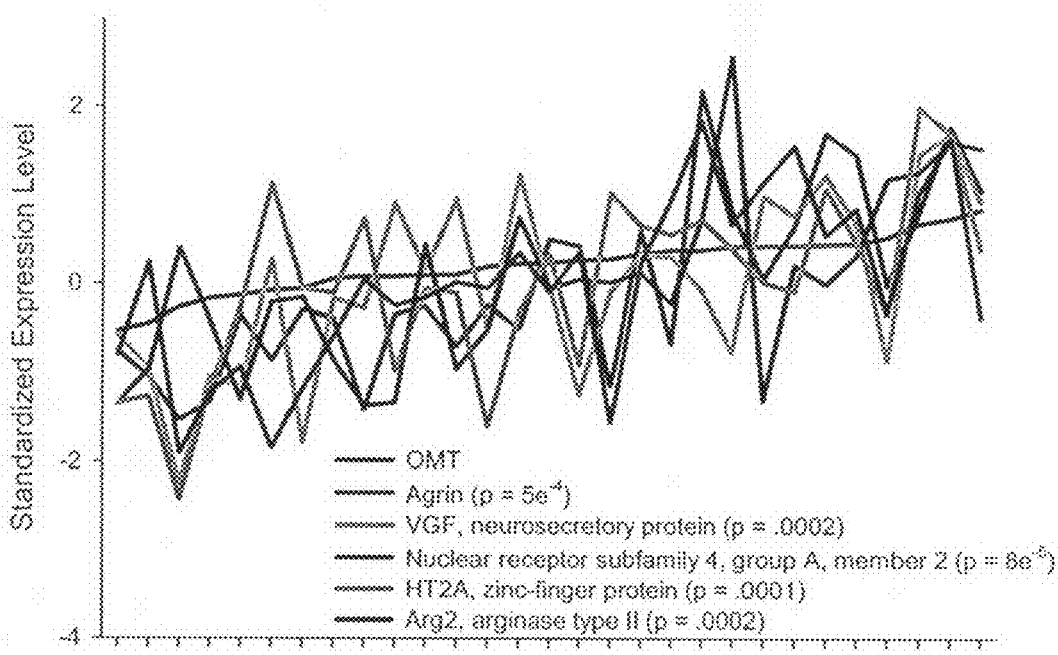
FIG. 3 is a set of line graphs showing correlation of gene expression and OMT across individual animals. Behavioral correlation is measured across all age groups. For genes that decreased with aging, the five best positive correlations (A) and for genes that increased with aging, the five best negative correlations (B) are shown (see Legend: correlation p-values in parentheses). Standardized values for both expression and OMT performance are shown on the Y-axis. The animals were ranked for OMT performance on the X-axis, from worst (1) to best (29), and OMT performance was plotted as a heavy black line on both A and B for the purposes of comparison. Genes involved in early responses and synaptic remodeling were among the five most highly correlated genes that decreased with aging, whereas those related to actin assembly and inflammation were among the five most highly correlated genes that increased with aging.
Figure 3:
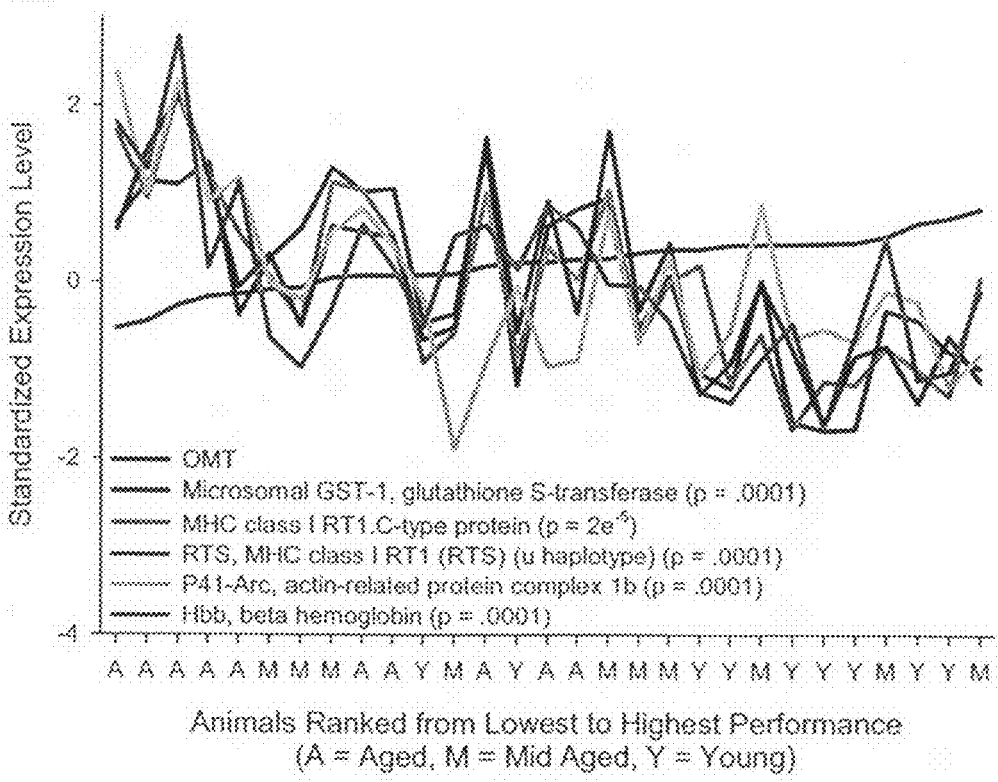

The expression of 161 of the 233 ANOVA-significant genes was correlated significantly with behavioral performance on memory-dependent tasks ($p \leq 0.025$; ACGs). Of these, 84 were significantly correlated with both OMT and SWM performance, 40 were significantly correlated with OMT, and 37 were significantly correlated with SMW (FIG. 2, step 3a). Of the 233 genes significant by ANOVA across age, 72 were significantly correlated with neither OMT nor SWM. Of these, 11 were significant by ANOVA across age at the more stringent p-value of $\leq 0.001$ (FIG. 2, step 3b) and were included for further analysis. Of the 161 ACGs, 64 exhibited decreased expression with aging and 97 exhibited increased expression with aging. Examples of the correlation patterns with behavior in the Aged group for the genes with the five highest correlations in each direction are shown in FIG. 3.

Because of the voluminous literature involved, many relevant citations are not included here. In addition to the "dual function" status of some genes, the functions of many are not completely understood, and therefore, the categorization here, while generally consistent with published reports, is not definitive.

ACGs that were downregulated with aging (TABLE 1A) appeared primarily to represent metabolic and neuronal functions. A substantial number of them fell into the category of oxidative metabolism (TABLE 1A). Many also fell into categories of synaptic/neuritic remodeling or other activity-dependent neuronal processes, e.g., immediate early genes (IEGs) (TABLE 1A). Conversely, ACGs that were upregulated with aging fit primarily into categories that appeared to reflect activated inflammatory response (TABLE 1B).

Additionally, among the main unexpected findings was a widespread upregulation in the expression of multiple genes encoding proteins for myelin synthesis (TABLE 1B) and lipid turnover (TABLE 1B). These various categories, overall, are consistent with a downward shift of oxidative metabolism in parallel with a major upregulation of lipid metabolism.

EXAMPLE 4

Genes Identified by the Method of the Invention

The following tables provide additional results from the tests performed above, and supplement the results presented in TABLES 1A and B.

TABLE 2

ESTs That Were Aging And Cognition Related or Showed Highly Significant Age-Dependent Changes in Expression Level

| SEQ ID NO: | GenBank | Description | Young | Mid | Age | FC | ANOVA p |
|---|---|---|---|---|---|---|---|
| | | Decreased with Age | | | | | |
| | | Correlated with both OMT and SWM | | | | | |
| SEQ ID NO: 153 | AA963449 | UI-R-E1-gj-e-08-0-UI.s1 cDNA | 2499 ± 80 | 2122 ± 102 | 1874 ± 37 | −1.33 | 0.0000 |
| SEQ ID NO: 154 | AA892532 | EST196335 cDNA | 4156 ± 85 | 4194 ± 80 | 3715 ± 100 | −1.12 | 0.0010 |
| SEQ ID NO: 155 | AA859626 | UI-R-E0-bs-h-02-0-UI.s1 cDNA | 853 ± 22 | 705 ± 23 | 714 ± 35 | −1.20 | 0.0013 |
| SEQ ID NO: 156 | AA893743 | EST197546cDNA | 2292 ± 63 | 1985 ± 80 | 1846 ± 92 | −1.24 | 0.0022 |
| SEQ ID NO: 157 | AI233365 | EST230053 cDNA | 8460 ± 232 | 7572 ± 289 | 7151 ± 226 | −1.18 | 0.0042 |
| SEQ ID NO: 158 | H31665 | EST105952cDNA | 1160 ± 56 | 1017 ± 34 | 942 ± 38 | −1.23 | 0.0051 |
| SEQ ID NO: 159 | AA892353 | ESTs, Moderately similar to JC5823 NADH dehydrogenase | 890 ± 59 | 796 ± 66 | 602 ± 47 | −1.48 | 0.0054 |
| SEQ ID NO: 160 | AI639247 | mixed-tissue library cDNA clone rx03939 3 | 945 ± 36 | 814 ± 45 | 749 ± 36 | −1.26 | 0.0063 |
| SEQ ID NO: 161 | AA858617 | UI-R-E0-bq-b-06-0-UI.s1 cDNA | 397 ± 17 | 294 ± 32 | 285 ± 22 | −1.39 | 0.0072 |
| SEQ ID NO: 162 | AI639429 | mixed-tissue library cDNA clone rx00973 3 | 341 ± 31 | 350 ± 22 | 252 ± 21 | −1.35 | 0.0148 |
| SEQ ID NO: 163 | AA858620 | UI-R-E0-b-09-0-UI.s1 cDNA | 153 ± 24 | 93 ± 10 | 86 ± 14 | −1.78 | 0.0160 |

TABLE 2-continued

ESTs That Were Aging And Cognition Related or Showed Highly Significant Age-Dependent Changes in Expression Level

| SEQ ID NO: | GenBank | Description | Young | Mid | Age | FC | ANOVA p |
|---|---|---|---|---|---|---|---|
| | | Correlated with OMT | | | | | |
| SEQ ID NO: 164 | AA866291 | UI-R-A0-ac-e-12-0-UI.s3 cDNA | 13818 ± 281 | 12477 ± 171 | 11987 ± 406 | −1.15 | 0.0008 |
| SEQ ID NO: 165 | AA894104 | EST197907 cDNA | 5716 ± 164 | 5259 ± 156 | 4871 ± 179 | −1.17 | 0.0060 |
| SEQ ID NO: 166 | AA799996 | EST189493 cDNA | 4881 ± 67 | 4812 ± 110 | 4407 ± 120 | −1.11 | 0.0066 |
| SEQ ID NO: 167 | AA892805 | EST196608 cDNA | 6563 ± 147 | 6174 ± 247 | 5645 ± 212 | −1.16 | 0.0176 |
| SEQ ID NO: 168 | AI639019 | mixed-tissue library cDNA clone rx01107 3 | 353 ± 19 | 315 ± 24 | 265 ± 16 | −1.33 | 0.0188 |
| SEQ ID NO: 169 | AA799538 | EST189035 cDNA | 1436 ± 156 | 1337 ± 76 | 963 ± 117 | −1.49 | 0.0211 |
| | | Correlated with SWM | | | | | |
| SEQ ID NO: 170 | AI070108 | UI-R-Y0-lu-a-09-0-UI.s1 cDNA | 1542 ± 36 | 1327 ± 39 | 1307 ± 58 | −1.18 | 0.0022 |
| SEQ ID NO: 171 | AA866409 | UI-R-E0-ch-a-03-0-UI.s1 cDNA | 994 ± 38 | 814 ± 37 | 819 ± 35 | −1.21 | 0.0026 |
| SEQ ID NO: 172 | AA859632 | UI-I-E0-bs-h-08-0-UI.s1 cDNA | 415 ± 53 | 352 ± 17 | 247 ± 18 | −1.68 | 0.0040 |
| SEQ ID NO: 173 | AA891651 | EST195454 Cdna | 16635 ± 723 | 15405 ± 589 | 13530 ± 521 | −1.23 | 0.0051 |
| SEQ ID NO: 174 | AA893032 | ESTs, Moderately similar to CALX calnexin precursor | 606 ± 26 | 491 ± 30 | 501 ± 17 | −1.21 | 0.0060 |
| SEQ ID NO: 175 | AA891965 | EST195768 Cdna | 2353 ± 55 | 2260 ± 60 | 2088 ± 45 | −1.13 | 0.0060 |
| SEQ ID NO: 176 | AA800708 | ESTs, Weakly similar to S28312 hypothetical protein F02A9.4 | 1042 ± 38 | 945 ± 43 | 805 ± 58 | −1.29 | 0.0065 |
| SEQ ID NO: 177 | AA964320 | UI-R-C0-gu-e-09-0-UI.s1 cDNA | 18110 ± 355 | 17683 ± 319 | 16605 ± 293 | −1.09 | 0.0082 |
| SEQ ID NO: 178 | AA893173 | EST196976 cDNA | 9712 ± 294 | 8674 ± 503 | 8155 ± 222 | −1.19 | 0.0196 |
| SEQ ID NO: 179 | H32977 | EST108553 cDNA | 3159 ± 74 | 2640 ± 85 | 2698 ± 66 | −1.17 | 0.0001 |
| SEQ ID NO: 180 | AA874887 | UI-I-E0-ci-g-10-0-UI.s1 cDNA | 459 ± 43 | 284 ± 23 | 316 ± 11 | −1.45 | 0.0004 |
| SEQ ID NO: 181 | AA850781 | EST193549 cDNA | 1886 ± 54 | 1570 ± 55 | 1602 ± 49 | −1.18 | 0.0004 |
| | | Increased with Age Correlated with both OMT and SWM | | | | | |
| SEQ ID NO: 182 | AI176456 | ESTs, Weakly similar to endothelial actin-binding protein | 8156 ± 447 | 9404 ± 462 | 12460 ± 511 | 1.53 | 0.0000 |
| SEQ ID NO: 183 | H31418 | EST105434 Cdna | 1176 ± 92 | 1530 ± 66 | 1904 ± 83 | 1.62 | 0.0000 |
| SEQ ID NO: 184 | AA858588 | ESTs, Weakly similar to dihydrolipoamide acetyl transferase | 2740 ± 80 | 2824 ± 86 | 3466 ± 198 | 1.26 | 0.0014 |
| SEQ ID NO: 185 | AA891785 | EST195588 cDNA | 1140 ± 122 | 1299 ± 82 | 1675 ± 89 | 1.47 | 0.0021 |
| SEQ ID NO: 186 | AA799803 | ESTs, Weakly similar to K1CU cytoskeletal keratin (type 1) | 149 ± 35 | 227 ± 28 | 297 ± 20 | 1.99 | 0.0035 |
| SEQ ID NO: 187 | AA799449 | EST, Weakly similar to ubiquitin carboxyl-terminal hydrolase 4 | −80 ± 7 | −2 ± 26 | 17 ± 19 | 1.00 | 0.0044 |
| | | Correlated with OMT | | | | | |
| SEQ ID NO: 188 | AA859777 | UI-R-E0-bu-e-10-0-UI.s1 cDNA | 1001 ± 43 | 1396 ± 76 | 1437 ± 87 | 1.44 | 0.0004 |
| SEQ ID NO: 189 | AI639532 | mixed-tissue library cDNA clone rx01030 3 | 209 ± 16 | 282 ± 18 | 317 ± 22 | 1.52 | 0.0018 |
| SEQ ID NO: 190 | AA875059 | UI-R-E0-cb-f-04-0-UI.s1 | 233 ± 20 | 219 ± 12 | 297 ± 14 | 1.28 | 0.0023 |
| SEQ ID NO: 191 | AI012051 | EST206502 cDNA | 786 ± 68 | 987 ± 58 | 1200 ± 101 | 1.53 | 0.0042 |
| SEQ ID NO: 192 | AA800549 | EST1900436 cDNA | 3647 ± 121 | 4078 ± 223 | 4573 ± 231 | 1.25 | 0.0132 |
| | | Correlated with SWM | | | | | |
| SEQ ID NO: 193 | AA799854 | EST189351 cDNA | 211 ± 49 | 328 ± 46 | 487 ± 60 | 2.31 | 0.0037 |
| SEQ ID NO: 194 | AA892520 | EST196323 cDNA | 834 ± 38 | 826 ± 29 | 960 ± 36 | 1.15 | 0.0152 |
| SEQ ID NO: 195 | AA893607 | EST197410 cDNA | −9 ± 19 | 69 ± 20 | 122 ± 22 | 1.99 | 0.0006 |
| SEQ ID NO: 196 | AI639381 | mixed-tissue library cDNA clone rx01495 3 | 1531 ± 148 | 2417 ± 152 | 2353 ± 189 | 1.54 | 0.0013 |

TABLE 3

Genes and ESTs with Significant Age-Dependent Changes in Expression Level (ANOVA; p ≤ .05 That Did Not Appear in TABLES 1 and 2

| SEQ ID NO: | GenBank | Descriptions | Young | Mid | Age | FC | ANOVA p |
|---|---|---|---|---|---|---|---|
| | | Genes, Decreased Correlate with both OMT and SWM | | | | | |
| SEQ ID NO: 197 | M93273 | somatostatin receptor subtype 2 | 1338 ± 142 | 1395 ± 105 | 1016 ± 30 | −1.32 | 0.0252 |
| SEQ ID NO: 198 | AI175973 | ESTs, Highly similar to NADH dehydrogenase | 157 ± 18 | 136 ± 16 | 95 ± 14 | −1.64 | 0.0314 |
| SEQ ID NO: 199 | AA799724 | ESTs, Highly similar to DNA-directed RNA polymeraseI | 2375 ± 47 | 2384 ± 79 | 2120 ± 91 | −1.12 | 0.0321 |
| SEQ ID NO: 200 | X06769 | FBJ v-fos oncogene homolog | 1672 ± 156 | 1340 ± 154 | 1145 ± 79 | −1.46 | 0.0329 |
| SEQ ID NO: 201 | X89696 | TPCR06 protein | 763 ± 50 | 625 ± 38 | 620 ± 35 | −1.23 | 0.0361 |

TABLE 3-continued

Genes and ESTs with Significant Age-Dependent Changes in Expression Level
(ANOVA; p ≦ .05 That Did Not Appear in TABLES 1 and 2

| SEQ ID NO: | GenBank | Descriptions | Young | Mid | Age | FC | ANOVA p |
|---|---|---|---|---|---|---|---|
| SEQ ID NO: 202 | D29766 | v-crk-associated tyrosine kinase substrate | 2478 ± 129 | 1929 ± 256 | 1568 ± 269 | −1.58 | 0.0362 |
| SEQ ID NO: 203 | AI102839 | Cerebellar Ca-binding protein, spot 35 protein | 2552 ± 110 | 2321 ± 131 | 2088 ± 110 | −1.22 | 0.0364 |
| SEQ ID NO: 204 | M80550 | Adenylyl cyclase | 6464 ± 207 | 6010 ± 212 | 5752 ± 133 | −1.12 | 0.0403 |
| SEQ ID NO: 205 | U18771 | Ras-related protein Rab-26 | 2631 ± 67 | 2373 ± 101 | 2350 ± 66 | −1.12 | 0.0410 |
| SEQ ID NO: 206 | M36453 | Inhibin-alpha | 1438 ± 74 | 1350 ± 73 | 1178 ± 64 | −1.22 | 0.0449 |
| Correlated with OMT | | | | | | | |
| SEQ ID NO: 207 | AF055477 | L-type voltage-dependent $Ca^{2+}$ channel (α1D subunit) | 2917 ± 144 | 2688 ± 119 | 2449 ± 74 | −1.19 | 0.0275 |
| SEQ ID NO: 208 | AI013627 | defender against cell death 1 | 10148 ± 175 | 9237 ± 310 | 9312 ± 219 | −1.09 | 0.0289 |
| SEQ ID NO: 209 | AA891916 | membrane interacting protein of RGS16 | 4586 ± 148 | 4330 ± 114 | 4117 ± 81 | −1.11 | 0.0295 |
| SEQ ID NO: 210 | X67805 | Synaptonemal complex protein 1 | 242 ± 22 | 189 ± 28 | 145 ± 23 | −1.67 | 0.0319 |
| SEQ ID NO: 211 | D10874 | lysosomal vacuolar proton pump (16 kDa) | 23958 ± 745 | 21491 ± 849 | 21100 ± 812 | −1.14 | 0.0436 |
| SEQ ID NO: 212 | D45247 | proteasome subunit RCX | 13926 ± 267 | 13333 ± 391 | 12526 ± 432 | −1.11 | 0.0477 |
| SEQ ID NO: 213 | AF040954 | putative protein phosphatase 1 nuclear targeting subunit | 1258 ± 27 | 1173 ± 35 | 1149 ± 28 | −1.09 | 0.0515 |
| Correlated with SWM | | | | | | | |
| SEQ ID NO: 214 | D10262 | choline kinase | 1248 ± 62 | 1092 ± 44 | 1079 ± 33 | −1.16 | 0.0345 |
| SEQ ID NO: 215 | AI178921 | Insulin degrading enzyme | 174 ± 24 | 163 ± 9 | 111 ± 17 | −1.56 | 0.0376 |
| SEQ ID NO: 216 | L29573 | neurotransmitter transporter, noradrenalin | 455 ± 47 | 342 ± 23 | 344 ± 31 | −1.32 | 0.0475 |
| No significant behavioral correlations | | | | | | | |
| SEQ ID NO: 217 | U75405 | procollagen, type I, alpha I | 490 ± 18 | 378 ± 34 | 346 ± 22 | −1.42 | 0.0017 |
| SEQ ID NO: 218 | L26292 | Kruppel-like factor 4 (gut) | 173 ± 21 | 100 ± 13 | 95 ± 10 | −1.83 | 0.0018 |
| SEQ ID NO: 219 | AI169265 | Atp6s1 | 18405 ± 380 | 16537 ± 447 | 16547 ± 318 | −1.11 | 0.0027 |
| SEQ ID NO: 220 | L13202 | RATHFH2 HNF-3/fork-head homolog-2 (HFH-2) | 799 ± 63 | 557 ± 71 | 512 ± 19 | −1.56 | 0.0027 |
| SEQ ID NO: 221 | AA799779 | acyl-CoA:dihydroxyacetonephosphate acyltransferase | 2742 ± 82 | 2363 ± 122 | 2181 ± 100 | −1.26 | 0.0030 |
| SEQ ID NO: 222 | D89340 | dipeptidylpeptidase III | 2158 ± 76 | 1824 ± 68 | 1848 ± 64 | −1.17 | 0.0038 |
| SEQ ID NO: 223 | AF019974 | Chromogranin B, parathyroid secretory protein | 10172 ± 290 | 8502 ± 400 | 8604 ± 334 | −1.18 | 0.0038 |
| SEQ ID NO: 224 | U72620 | Lot1 | 760 ± 52 | 620 ± 54 | 511 ± 35 | −1.49 | 0.0042 |
| SEQ ID NO: 225 SEQ ID NO: 257 | U17254 | immediate early gene transcription factor NGFI-B | 3291 ± 202 | 2559 ± 115 | 2496 ± 180 | −1.32 | 0.0045 |
| SEQ ID NO: 226 | M83745 | Protein convertase subtilisin/kexin, type I | 815 ± 43 | 630 ± 58 | 578 ± 39 | −1.41 | 0.0048 |
| SEQ ID NO: 227 | AA893708 | KIAA0560 | 2575 ± 62 | 2328 ± 84 | 2203 ± 74 | −1.17 | 0.0061 |
| SEQ ID NO: 228 | H33725 | associated molecule with the SH3 domain of STAM | 1102 ± 26 | 970 ± 32 | 943 ± 41 | −1.17 | 0.0064 |
| SEQ ID NO: 229 | AI230914 | farnesyltransferase beta subunit | 4044 ± 97 | 3465 ± 130 | 3498 ± 148 | −1.16 | 0.0065 |
| SEQ ID NO: 230 | D37951 | MIBP1 (c-myc intron binding protein 1) | 6374 ± 194 | 5826 ± 173 | 5601 ± 100 | −1.14 | 0.0067 |
| SEQ ID NO: 231 | AF076183 | cytosolic sorting protein PACS-1a (PACS-1) | 5098 ± 314 | 4039 ± 263 | 3774 ± 269 | −1.35 | 0.0072 |
| SEQ ID NO: 232 | X82445 | nuclear distribution gene C homolog (*Aspergillus*) | 3311 ± 111 | 2910 ± 85 | 2901 ± 87 | −1.14 | 0.0072 |
| SEQ ID NO: 233 | AA800948 | Tuba4 | 8512 ± 215 | 7857 ± 402 | 6875 ± 342 | −1.24 | 0.0076 |
| SEQ ID NO: 234 | D10699 | ubiquitin carboxy-terminal hydrolase L1 | 19927 ± 1108 | 16996 ± 631 | 16532 ± 478 | −1.21 | 0.0090 |
| SEQ ID NO: 235 | X57281 | Glycine receptor alpha 2 subunit | 199 ± 28 | 118 ± 19 | 111 ± 13 | −1.79 | 0.0096 |
| SEQ ID NO: 236 | X76985 | latexin | 3937 ± 114 | 3187 ± 165 | 3332 ± 201 | −1.18 | 0.0105 |
| SEQ ID NO: 237 | X84039 | lumican | 398 ± 30 | 283 ± 15 | 281 ± 36 | −1.42 | 0.0109 |
| SEQ ID NO: 238 | U89905 | alpha-methylacyl-CoA racemase | 927 ± 39 | 793 ± 33 | 793 ± 27 | −1.17 | 0.0110 |
| SEQ ID NO: 239 | M24852 | Neuron specific protein PEP-19 (Purkinje cell protein 4) | 6759 ± 349 | 5578 ± 280 | 5483 ± 310 | −1.23 | 0.0146 |
| SEQ ID NO: 240 | U75917 | clathrin-associated protein 17 | 6585 ± 232 | 5368 ± 330 | 5557 ± 291 | −1.18 | 0.0158 |
| SEQ ID NO: 241 | X53427 | glycogen synthase kinase 3 alpha (EC 2.7.1.37) | 9799 ± 148 | 8843 ± 366 | 8572 ± 281 | −1.14 | 0.0161 |
| SEQ ID NO: 242 | U28938 | receptor-type protein tyrosine phosphatase D30 | 1564 ± 91 | 1354 ± 50 | 1286 ± 51 | −1.22 | 0.0163 |
| SEQ ID NO: 243 | AA891880 | Loc65042 | 2931 ± 59 | 2607 ± 85 | 2607 ± 98 | −1.12 | 0.0171 |
| SEQ ID NO: 244 | AI232268 | LDL recepsor-related protein associated protein 1 | 1708 ± 68 | 1504 ± 59 | 1493 ± 36 | −1.14 | 0.0186 |
| SEQ ID NO: 245 | AI045249 | heat shock 70 kD protein 8 | 537 ± 42 | 467 ± 46 | 366 ± 29 | −1.47 | 0.0195 |
| SEQ ID NO: 246 | AF095927 | protein phosphatase 2C | 2968 ± 120 | 2516 ± 91 | 2549 ± 132 | −1.16 | 0.0197 |
| SEQ ID NO: 247 | AA819708 | Cox 7a3 | 18590 ± 404 | 17401 ± 452 | 16742 ± 433 | −1.11 | 0.0201 |
| SEQ ID NO: 248 | AA866257 | ESTs | 4750 ± 198 | 3994 ± 261 | 4021 ± 99 | −1.18 | 0.0205 |
| SEQ ID NO: 249 | AA942685 | cytosolic cysteine dioxygenase 1 | 9391 ± 397 | 8145 ± 443 | 7797 ± 325 | −1.20 | 0.0221 |

TABLE 3-continued

Genes and ESTs with Significant Age-Dependent Changes in Expression Level
(ANOVA; p ≦ .05 That Did Not Appear in TABLES 1 and 2

| SEQ ID NO: | GenBank | Descriptions | Young | Mid | Age | FC | ANOVA p |
|---|---|---|---|---|---|---|---|
| SEQ ID NO: 250 | D16478 | mitochondrial long-chain enoyl-CoA hydratase | 3913 ± 78 | 3615 ± 95 | 3499 ± 118 | −1.12 | 0.0222 |
| SEQ ID NO: 251 | D88586 | eosinophil cationic protein | 2522 ± 108 | 2236 ± 206 | 1853 ± 138 | −1.36 | 0.0226 |
| | | No significant behaviorial correlations | | | | | |
| SEQ ID NO: 252 | E03229 | cytosolic cysteine dioxygenase 1 | 5643 ± 433 | 4518 ± 512 | 3918 ± 238 | −1.44 | 0.0227 |
| SEQ ID NO: 253 | AB006451 | Tim23 | 5968 ± 155 | 5562 ± 198 | 5315 ± 100 | −1.12 | 0.0241 |
| SEQ ID NO: 254 | M10068 | NADPH-cytochrome P-450 oxidoreductase | 5771 ± 205 | 4998 ± 190 | 5139 ± 191 | −1.12 | 0.0242 |
| SEQ ID NO: 255 | Z48225 | protein synthesis initiation factor eIF-2B delta subunit | 2710 ± 114 | 2415 ± 96 | 2327 ± 78 | −1.16 | 0.0260 |
| SEQ ID NO: 256 | M93669 | Secretogranin II | 4917 ± 225 | 4395 ± 136 | 4309 ± 105 | −1.14 | 0.0266 |
| SEQ ID NO: 225 | U17254 | immediate early gene transcription factor NGFI-B | 6004 ± 635 | 4395 ± 228 | 4694 ± 316 | −1.28 | 0.0269 |
| SEQ ID NO: 257 | U38801 | DNA polymerase beta | 1173 ± 61 | 1001 ± 45 | 997 ± 39 | −1.18 | 0.0270 |
| SEQ ID NO: 258 | AA874874 | ESTs, Highly similar to alcohol dehydrogenase class III | 3683 ± 64 | 3429 ± 83 | 3436 ± 60 | −1.07 | 0.0278 |
| SEQ ID NO: 259 | AB016532 | period homolog 2 (*Drosophila*) | 1440 ± 117 | 1116 ± 84 | 1135 ± 62 | −1.27 | 0.0290 |
| SEQ ID NO: 260 | AF007758 | synuclein, alpha | 17737 ± 473 | 15958 ± 751 | 15463 ± 459 | −1.15 | 0.0295 |
| SEQ ID NO: 261 | U04738 | Somatostatin receptor subtype 4 | 2066 ± 109 | 1680 ± 70 | 1733 ± 122 | −1.19 | 0.0300 |
| SEQ ID NO: 262 | AF007890 | resection-induced TPI (rsl 1) | 513 ± 48 | 388 ± 43 | 326 ± 50 | −1.58 | 0.0307 |
| SEQ ID NO: 263 | AA874969 | ESTs, Highly similar to c-Jun leucine zipper interactive | 8555 ± 211 | 7333 ± 326 | 7531 ± 387 | −1.14 | 0.0310 |
| SEQ ID NO: 264 | M31174 | thyroid hormone receptor alpha | 16273 ± 775 | 14217 ± 473 | 14395 ± 419 | −1.13 | 0.0312 |
| SEQ ID NO: 265 | AA801286 | Inositol (myo)-1(or4)-monophosphatase 1 | 4767 ± 151 | 4270 ± 199 | 4155 ± 118 | −1.15 | 0.0312 |
| SEQ ID NO: 266 | AF007554 | Mucin1 | 385 ± 29 | 276 ± 35 | 282 ± 26 | −1.37 | 0.0316 |
| SEQ ID NO: 267 | X98399 | solute carrier family 14, member 1 | 2002 ± 105 | 1555 ± 95 | 1615 ± 151 | −1.24 | 0.0329 |
| SEQ ID NO: 268 | AI168942 | branched chain keto acid dehydrogenase E1 | 1580 ± 73 | 1367 ± 58 | 1418 ± 30 | −1.11 | 0.0334 |
| SEQ ID NO: 269 | AF023087 | Early growth response 1 | 20068 ± 1720 | 16426 ± 661 | 16294 ± 622 | −1.23 | 0.0339 |
| SEQ ID NO: 270 | K02248 | Somatostatin | 4314 ± 165 | 3565 ± 189 | 3651 ± 225 | −1.18 | 0.0341 |
| SEQ ID NO: 271 | AA859954 | Vacuole Membrane Protein 1 | 4197 ± 122 | 3755 ± 119 | 3789 ± 128 | −1.11 | 0.0346 |
| SEQ ID NO: 272 | AI176621 | iron-responsive element-binding protein | 1505 ± 66 | 1334 ± 63 | 1287 ± 42 | −1.17 | 0.0348 |
| SEQ ID NO: 273 | AI010110 | SH3-domain GRB2-like 1 | 1981 ± 67 | 1596 ± 113 | 1669 ± 117 | −1.19 | 0.0363 |
| SEQ ID NO: 274 | L42855 | transcription elongation factor B (SIII) polypeptide 2 | 10836 ± 201 | 9654 ± 417 | 9859 ± 283 | −1.10 | 0.0368 |
| SEQ ID NO: 275 | AI136891 | zinc finger protein 36, C3H type-like 1 | 3892 ± 153 | 3427 ± 188 | 3247 ± 160 | −1.20 | 0.0369 |
| SEQ ID NO: 276 | S77492 | Bone morphogenetic protein 3 | 123 ± 15 | 103 ± 17 | 65 ± 14 | −1.89 | 0.0374 |
| SEQ ID NO: 277 | AI230778 | ESTs, Highly similar to protein-tyrosine sulfotrans. 2 | 2049 ± 41 | 2019 ± 120 | 1714 ± 101 | −1.20 | 0.0380 |
| SEQ ID NO: 278 | AA859980 | T-complex 1 | 1710 ± 77 | 1411 ± 71 | 1478 ± 90 | −1.16 | 0.0383 |
| SEQ ID NO: 279 | U27518 | UDP-glucuronosyltransferase | 316 ± 22 | 266 ± 26 | 223 ± 24 | −1.42 | 0.0394 |
| SEQ ID NO: 280 | AF030088 | RuvB-like protein 1 | 497 ± 151 | 252 ± 39 | 181 ± 21 | −2.74 | 0.0398 |
| SEQ ID NO: 281 | AF013144 | MAP-kinase phosphatase (cpg21) | 1551 ± 185 | 1100 ± 98 | 1149 ± 92 | −1.35 | 0.0408 |
| SEQ ID NO: 282 | M58404 | thymosin, beta 10 | 20359 ± 853 | 18136 ± 773 | 17948 ± 400 | −1.13 | 0.0413 |
| SEQ ID NO: 283 | AA819500 | ESTs, Highly similar to AC12__HUMAN 37 kD subunit | 532 ± 44 | 434 ± 30 | 411 ± 26 | −1.29 | 0.0417 |
| SEQ ID NO: 284 | AF020046 | integrin alpha E1, epithelial-associated | 113 ± 17 | 109 ± 12 | 70 ± 10 | −1.62 | 0.0419 |
| SEQ ID NO: 285 | D10854 | aldehyde reductase | 18091 ± 526 | 16744 ± 433 | 16538 ± 354 | −1.09 | 0.0422 |
| SEQ ID NO: 286 | AF000899 | p58/p45, nucleolin | 1666 ± 114 | 1381 ± 81 | 1359 ± 73 | −1.23 | 0.0430 |
| SEQ ID NO: 287 | S77858 | non-muscle myosin alkali light chain | 10848 ± 292 | 9865 ± 409 | 9642 ± 278 | −1.12 | 0.0435 |
| SEQ ID NO: 288 | J05031 | Isovaleryl Coenzyme A dehydrogenase | 1996 ± 57 | 1799 ± 75 | 1792 ± 45 | −1.11 | 0.0451 |
| SEQ ID NO: 289 | J02773 | heart fatty acid binding protein | 2242 ± 88 | 1918 ± 118 | 1885 ± 99 | −1.19 | 0.0453 |
| SEQ ID NO: 290 | AA891041 | jun B proto-oncogene | 1125 ± 128 | 788 ± 79 | 871 ± 68 | −1.29 | 0.0453 |
| SEQ ID NO: 291 | AA817887 | profiling | 12549 ± 398 | 10859 ± 592 | 10886 ± 498 | −1.15 | 0.0460 |
| SEQ ID NO: 292 | U38379 | Gamma-glutamyl hydrolase | 2340 ± 215 | 2136 ± 177 | 1693 ± 141 | −1.38 | 0.0467 |
| SEQ ID NO: 293 | D78308 | calreticulin | 8256 ± 349 | 7233 ± 343 | 7446 ± 126 | −1.11 | 0.0486 |
| SEQ ID NO: 294 | AA818487 | cyclophilin B | 8861 ± 410 | 7912 ± 293 | 7779 ± 236 | −1.14 | 0.0488 |
| SEQ ID NO: 295 | AA799479 | ESTs, Highly similar to NADH-ubiquinone oxidoreduct. | 4937 ± 203 | 4124 ± 291 | 4075 ± 263 | −1.21 | 0.0496 |
| SEQ ID NO: 296 | AI104388 | heat shock 27 kD protein 1 | 2102 ± 72 | 2072 ± 81 | 1839 ± 82 | −1.14 | 0.0511 |
| SEQ ID NO: 297 | X59737 | ubiquitous mitochondrial creatine kinase | 11016 ± 315 | 9658 ± 360 | 9950 ± 451 | −1.11 | 0.0512 |
| SEQ ID NO: 298 | D83948 | adult liver S1-1 protein | 1411 ± 45 | 1249 ± 78 | 1221 ± 30 | −1.16 | 0.0522 |
| SEQ ID NO: 299 | AA893788 | ESTs, Highly similar to chromobox protein homolog 5 | 658 ± 33 | 562 ± 23 | 568 ± 31 | −1.16 | 0.0541 |
| | | Genes, Increased Correlate with both OMT and SWM | | | | | |
| SEQ ID NO: 300 | AI230247 | selenoprotein P, plasma, 1 | 7467 ± 279 | 8179 ± 312 | 8700 ± 319 | 1.17 | 0.0304 |
| SEQ ID NO: 301 | AF016269 | kallikrein 6 (neurosin, zyme) | 1141 ± 75 | 1166 ± 51 | 1375 ± 72 | 1.21 | 0.0353 |

TABLE 3-continued

Genes and ESTs with Significant Age-Dependent Changes in Expression Level
(ANOVA; p ≤ .05 That Did Not Appear in TABLES 1 and 2

| SEQ ID NO: | GenBank | Descriptions | Young | Mid | Age | FC | ANOVA p |
|---|---|---|---|---|---|---|---|
| SEQ ID NO: 302 | AF021935 | Ser-Thr protein kinase | 2 ± 111 | 453 ± 193 | 649 ± 184 | 10.63 | 0.0395 |
| SEQ ID NO: 303 | M24104 | synaptobrevin 2 | 1145 ± 55 | 1783 ± 260 | 1794 ± 210 | 1.57 | 0.0544 |
| Correlate with OMT | | | | | | | |
| SEQ ID NO: 304 | AI235344 | geranylgeranyltransferase type I (GGTase-I) | 336 ± 21 | 362 ± 16 | 413 ± 21 | 1.23 | 0.0310 |
| SEQ ID NO: 305 | X60212 | ASI homolog of bacterial ribosomal subunit protein L22 | 17230 ± 994 | 18514 ± 1115 | 21606 ± 1305 | 1.25 | 0.0365 |
| SEQ ID NO: 306 | U14950 | tumor suppressor homolog (synapse associ. protein) | 315 ± 29 | 507 ± 61 | 498 ± 64 | 1.58 | 0.0379 |
| SEQ ID NO: 139 | X53504 | ribosomal protein L12 | 9290 ± 179 | 9922 ± 247 | 10210 ± 290 | 1.10 | 0.0448 |
| SEQ ID NO: 307 | AA955388 | Na$^+$K$^+$ transporting ATPase 2, beta polypeptide 2 | 2361 ± 155 | 2863 ± 320 | 3237 ± 170 | 1.37 | 0.0451 |
| SEQ ID NO: 308 | X76489 | CD9 cell surface glycoprotein | 2485 ± 199 | 2713 ± 135 | 3106 ± 170 | 1.25 | 0.0467 |
| SEQ ID NO: 309 | D28110 | myelin-associated oligodendrocytic basic protein | 5947 ± 490 | 7855 ± 539 | 8814 ± 1109 | 1.48 | 0.0499 |
| Correlate with SWM | | | | | | | |
| SEQ ID NO: 310 | U10357 | pyruvate dehydrogenase kinase 2 subunit p45 (PDK2) | 3565 ± 133 | 3921 ± 274 | 4485 ± 240 | 1.26 | 0.0292 |
| SEQ ID NO: 311 | D00569 | 2,4-dienoyl CoA reductase 1, mitochondrial | 200 ± 22 | 241 ± 32 | 307 ± 24 | 1.54 | 0.0293 |
| SEQ ID NO: 312 | AA818240 | Nuclear pore complex protein | 308 ± 35 | 440 ± 42 | 424 ± 28 | 1.38 | 0.0329 |
| SEQ ID NO: 303 | M24104 | synaptobrevin 2 | 685 ± 193 | 1379 ± 247 | 1581 ± 250 | 2.31 | 0.0332 |
| SEQ ID NO: 313 | D28557 | cold shock domain protein A | 1383 ± 89 | 1491 ± 129 | 1803 ± 106 | 1.30 | 0.0337 |
| SEQ ID NO: 314 | X54467 | cathepsin D | 3715 ± 294 | 4091 ± 388 | 5138 ± 431 | 1.38 | 0.0373 |
| SEQ ID NO: 315 | X13905 | ras-related rab1B protein | 201 ± 111 | 803 ± 179 | 689 ± 181 | 3.43 | 0.0388 |
| SEQ ID NO: 316 | AI228548 | ESTs, Highly similar to DKFZp586G0322.1 | 1909 ± 140 | 2053 ± 75 | 2321 ± 110 | 1.22 | 0.0412 |
| SEQ ID NO: 317 | V01244 | Prolactin | 75 ± 37 | 70 ± 37 | 354 ± 140 | 4.75 | 0.0476 |
| SEQ ID NO: 318 | L24896 | glutathione peroxidase 4 | 12303 ± 650 | 12725 ± 456 | 14045 ± 358 | 1.14 | 0.0479 |
| No significant behavioral correlations | | | | | | | |
| SEQ ID NO: 319 | U77777 | interleukin 18 | 252 ± 15 | 290 ± 12 | 371 ± 31 | 1.47 | 0.0025 |
| SEQ ID NO: 320 | AI102299 | Bid3 | 267 ± 98 | 527 ± 59 | 603 ± 21 | 2.26 | 0.0032 |
| SEQ ID NO: 321 | L19998 | Phenol-preferring sulfotransferase 1A | 373 ± 36 | 507 ± 27 | 616 ± 69 | 1.65 | 0.0065 |
| SEQ ID NO: 322 | AF051561 | solute carrier family 12, member 2 | 2749 ± 82 | 3228 ± 83 | 3281 ± 163 | 1.19 | 0.0074 |
| SEQ ID NO: 323 | U08259 | Glutamate receptor, N-methyl D-aspartate 2C | 919 ± 34 | 989 ± 49 | 1118 ± 38 | 1.22 | 0.0074 |
| SEQ ID NO: 324 | AB008538 | HB2 | 3733 ± 133 | 4436 ± 189 | 4264 ± 117 | 1.14 | 0.0087 |
| SEQ ID NO: 325 | AF016296 | neuropilin | 1838 ± 121 | 2279 ± 85 | 2259 ± 110 | 1.23 | 0.0111 |
| SEQ ID NO: 326 | X62950 | pBUS30 with repetitive elements | 360 ± 25 | 577 ± 67 | 548 ± 47 | 1.52 | 0.0124 |
| SEQ ID NO: 327 | AF030050 | replication factor C | 857 ± 62 | 1154 ± 73 | 1148 ± 81 | 1.34 | 0.0127 |
| SEQ ID NO: 328 | AA848831 | lysophosphatidic acid G-protein-couplet receptor, 2 | 1854 ± 170 | 2729 ± 225 | 2784 ± 261 | 1.50 | 0.0129 |
| SEQ ID NO: 329 | M91234 | VL30 element | 2573 ± 152 | 3409 ± 221 | 3467 ± 254 | 1.35 | 0.0134 |
| SEQ ID NO: 330 | J05132 | UDP-glucuronosyltransferase | 968 ± 76 | 1283 ± 68 | 1212 ± 74 | 1.25 | 0.0148 |
| SEQ ID NO: 331 | AF008554 | implantation-associated protein (IAG2) | 362 ± 46 | 528 ± 33 | 500 ± 40 | 1.38 | 0.0162 |
| SEQ ID NO: 332 | AI231807 | ferritin light chain 1 | 5496 ± 174 | 5863 ± 273 | 6469 ± 197 | 1.18 | 0.0163 |
| SEQ ID NO: 333 | S72594 | tissue inhibitor of metalloproteinase 2 | 3615 ± 205 | 4386 ± 216 | 4227 ± 114 | 1.17 | 0.0170 |
| SEQ ID NO: 334 | S61868 | Ryudocan/syndecan 4 | 6117 ± 292 | 6315 ± 211 | 7348 ± 385 | 1.20 | 0.0182 |
| SEQ ID NO: 335 | X06916 | S100 calcium-binding protein A4 | 572 ± 40 | 630 ± 60 | 868 ± 99 | 1.52 | 0.0184 |
| SEQ ID NO: 336 | U67136 | A kinase (PRKA) anchor protein 5 | 306 ± 59 | 531 ± 66 | 551 ± 61 | 1.80 | 0.0191 |
| SEQ ID NO: 337 | Y17295 | thiol-specific antioxidant protein (1-Cys peroxiredoxin) | 2414 ± 154 | 3037 ± 133 | 2998 ± 193 | 1.24 | 0.0221 |
| SEQ ID NO: 338 | D45249 | protease (prosome, macropain) 28 subbunit, alpha | 4169 ± 119 | 4657 ± 205 | 4808 ± 121 | 1.15 | 0.0223 |
| SEQ ID NO: 339 | U67137 | guanylate kinase associated protein | 3198 ± 366 | 4262 ± 333 | 4338 ± 177 | 1.36 | 0.0229 |
| SEQ ID NO: 340 | AF074608 | MHC class I antigen (RT1.EC2) gene | 782 ± 129 | 940 ± 110 | 1213 ± 69 | 1.55 | 0.0231 |
| SEQ ID NO: 341 | U67080 | r-MyT13 | −29 ± 17 | 74 ± 38 | 92 ± 32 | 1.50 | 0.0250 |
| SEQ ID NO: 342 | AI013861 | 3-hydroxyisobutyrate dehydrogenase | 3347 ± 136 | 3759 ± 101 | 3678 ± 73 | 1.10 | 0.0255 |
| SEQ ID NO: 343 | S53527 | S100 calcium-binding protein, beta (neural) | 25683 ± 925 | 25830 ± 765 | 29195 ± 1184 | 1.14 | 0.0266 |
| SEQ ID NO: 344 | D89730 | Fibulin 3, fibulin-like extracellular matrix protein I | 239 ± 23 | 351 ± 52 | 424 ± 50 | 1.78 | 0.0271 |
| SEQ ID NO: 345 | D90211 | Lysosomal-associated membrane protein 2 | 3095 ± 142 | 3577 ± 157 | 3715 ± 168 | 1.20 | 0.0276 |
| SEQ ID NO: 346 | AA859645 | attractin | 2647 ± 81 | 2871 ± 82 | 2942 ± 60 | 1.11 | 0.0278 |

TABLE 3-continued

Genes and ESTs with Significant Age-Dependent Changes in Expression Level
(ANOVA; p ≤ .05 That Did Not Appear in TABLES 1 and 2

| SEQ ID NO: | GenBank | Descriptions | Young | Mid | Age | FC | ANOVA p |
|---|---|---|---|---|---|---|---|
| SEQ ID NO: 347 | X55153 | ribosomal protein P2 | 18829 ± 779 | 19676 ± 485 | 21368 ± 641 | 1.13 | 0.0284 |
| SEQ ID NO: 348 | M55015 | nucleolin | 6685 ± 139 | 6738 ± 263 | 7385 ± 147 | 1.10 | 0.0297 |
| SEQ ID NO: 349 | L25605 | Dynamin 2 | 759 ± 84 | 780 ± 71 | 1109 ± 129 | 1.46 | 0.0303 |
| SEQ ID NO: 332 | AI231807 | ferritin light chain 1 | 9399 ± 508 | 10459 ± 538 | 11268 ± 329 | 1.20 | 0.0312 |
| SEQ ID NO: 350 | L00191 | Fibronectin I | 395 ± 23 | 530 ± 44 | 557 ± 53 | 1.41 | 0.0316 |
| SEQ ID NO: 309 | D28110 | myelin-associated oligodendrocytic basic protein | 837 ± 127 | 1177 ± 106 | 1331 ± 141 | 1.59 | 0.0320 |
| SEQ ID NO: 351 | AI176595 | cathepsin L | 2414 ± 73 | 2639 ± 57 | 2678 ± 80 | 1.11 | 0.0324 |
| SEQ ID NO: 352 | X14323 | Fc receptor, IgG, alpha chain transporter | 431 ± 38 | 510 ± 71 | 640 ± 42 | 1.49 | 0.0328 |
| SEQ ID NO: 353 | X74226 | LL5 protein | 2042 ± 69 | 2000 ± 66 | 2279 ± 92 | 1.12 | 0.0330 |
| SEQ ID NO: 354 | AA892775 | Lysozyme | 1760 ± 88 | 1781 ± 65 | 2438 ± 314 | 1.39 | 0.0337 |
| SEQ ID NO: 355 | X02904 | glutathione S-transferase P subunit | 2861 ± 124 | 3514 ± 276 | 3570 ± 141 | 1.25 | 0.0339 |
| SEQ ID NO: 356 | AI012589 | glutathione S-transferase, pi 2 | 6325 ± 340 | 7706 ± 465 | 7807 ± 418 | 1.23 | 0.0353 |
| SEQ ID NO: 357 | AB000778 | Phoshpolipase D gene 1 | 194 ± 24 | 270 ± 18 | 287 ± 31 | 1.48 | 0.0374 |
| SEQ ID NO: 358 | X97443 | integral membrame protein Tmp21-I(p23) | 862 ± 64 | 1194 ± 131 | 1211 ± 90 | 1.40 | 0.0396 |
| SEQ ID NO: 359 | X58294 | carbonic anhydrase 2 | 5372 ± 252 | 6554 ± 399 | 6347 ± 290 | 1.18 | 0.0398 |
| SEQ ID NO: 360 | M99485 | Myelin oligodendrocyte glycoprotein | 2546 ± 107 | 2645 ± 113 | 3176 ± 259 | 1.25 | 0.0405 |
| SEQ ID NO: 361 | M23601 | Monoamine oxidase B | 4962 ± 268 | 5244 ± 152 | 5763 ± 212 | 1.16 | 0.0406 |
| SEQ ID NO: 362 | J05022 | peptidylarginine deiminase | 3834 ± 133 | 4231 ± 137 | 4503 ± 231 | 1.17 | 0.0425 |
| SEQ ID NO: 363 | Z49858 | plasmolipin | 2111 ± 146 | 2437 ± 69 | 2624 ± 172 | 1.24 | 0.0429 |
| SEQ ID NO: 364 | D17309 | delta 4-3-ketosteroid-5-beta-reductase | 568 ± 66 | 930 ± 96 | 951 ± 150 | 1.67 | 0.0432 |
| SEQ ID NO: 365 | AA955306 | ras-related protein rab10 | 3912 ± 289 | 4796 ± 339 | 4975 ± 257 | 1.27 | 0.0444 |
| SEQ ID NO: 366 | M19936 | Prosaposin-sphingolipid hydrolase activator | 12981 ± 997 | 14182 ± 780 | 16095 ± 751 | 1.24 | 0.0463 |
| SEQ ID NO: 367 | M57276 | Leukocyte antigen (Ox044) | 879 ± 79 | 1071 ± 65 | 1117 ± 57 | 1.27 | 0.0469 |
| SEQ ID NO: 368 | J02752 | acyl-coA osidase | 1853 ± 119 | 2187 ± 155 | 2344 ± 118 | 1.26 | 0.0470 |
| SEQ ID NO: 369 | U78517 | cAMP-regulated guanine nucleotide exchange factor II | 3400 ± 134 | 3956 ± 216 | 3903 ± 113 | 1.15 | 0.0477 |
| SEQ ID NO: 370 | AI102031 | myc box dependent interacting protein 1 | 6381 ± 242 | 6919 ± 237 | 7265 ± 236 | 1.14 | 0.0486 |
| SEQ ID NO: 371 | M89646 | ribosomal protein S24 | 14041 ± 448 | 15044 ± 319 | 15482 ± 416 | 1.10 | 0.0491 |
| SEQ ID NO: 372 | AA924925 | ER transmembrane protein Dri 42 | 435 ± 209 | 799 ± 143 | 1067 ± 160 | 2.45 | 0.0493 |
| SEQ ID NO: 373 | X16933 | RNA binding protein p45AUF1 | 1516 ± 166 | 2186 ± 203 | 2139 ± 221 | 1.41 | 0.0499 |
| SEQ ID NO: 374 | X72757 | cox Via gene (liver) | 666 ± 73 | 855 ± 39 | 829 ± 51 | 1.24 | 0.0502 |
| SEQ ID NO: 375 | AA957132 | N-acetylglucosaminyltransferase I | 242 ± 26 | 401 ± 64 | 398 ± 54 | 1.64 | 0.0508 |
| SEQ ID NO: 85 | AA818025 | CD59 antigen | 5668 ± 298 | 6175 ± 280 | 6909 ± 414 | 1.22 | 0.0509 |
| SEQ ID NO: 376 | AI237007 | ESTs, Highly similar to flavoprot.-ubiquin. Oxidoreduct. | 48 ± 37 | 117 ± 50 | 195 ± 29 | 3.19 | 0.0519 |
| SEQ ID NO: 377 | U07619 | Coagulation factor III (thromboplastin, tissue factor) | 701 ± 37 | 792 ± 37 | 847 ± 46 | 1.21 | 0.0544 |
| ESTs, Decreased | | | | | | | |
| Correlate with both OMT and SWM | | | | | | | |
| SEQ ID NO: 378 | AA874830 | UI-R-E0-cg-f-04-0-UI.s1 cDNA | 1584 ± 87 | 1406 ± 65 | 1323 ± 33 | -1.20 | 0.0268 |
| SEQ ID NO: 379 | AA875032 | UI-R-E0-cb-h-09-0-UI.s1 cDNA | 1770 ± 40 | 1536 ± 91 | 1490 ± 72 | -1.19 | 0.0288 |
| SEQ ID NO: 380 | AA799599 | EST189096 CDNA | 6628 ± 210 | 6184 ± 281 | 5618 ± 257 | -1.18 | 0.0328 |
| SEQ ID NO: 381 | AA892813 | EST196616 cDNA | 218 ± 41 | 241 ± 54 | 92 ± 25 | -2.37 | 0.0363 |
| SEQ ID NO: 382 | AA799529 | EST189026 cDNA | 1590 ± 61 | 1529 ± 51 | 1388 ± 55 | -1.15 | 0.0466 |
| SEQ ID NO: 383 | AA893584 | EST197387 cDNA | 4021 ± 120 | 3570 ± 206 | 3416 ± 167 | -1.18 | 0.0548 |
| Correlate with OMT | | | | | | | |
| SEQ ID NO: 384 | AA894305 | EST198108 cDNA | 4779 ± 107 | 4393 ± 138 | 4261 ± 151 | -1.12 | 0.0349 |
| SEQ ID NO: 385 | AA800622 | EST190119 cDNA | 2372 ± 76 | 2325 ± 102 | 2056 ± 83 | -1.15 | 0.0370 |
| SEQ ID NO: 386 | AA893690 | EST197493 CDNA | 5102 ± 229 | 4813 ± 146 | 4334 ± 220 | -1.18 | 0.0378 |
| SEQ ID NO: 387 | AA891221 | EST195024 cDNA | 4562 ± 179 | 4159 ± 173 | 3956 ± 128 | -1.15 | 0.0423 |
| SEQ ID NO: 388 | AA893320 | EST197123 CDNA | 1110 ± 35 | 1071 ± 69 | 911 ± 57 | -1.22 | 0.0455 |
| SEQ ID NO: 389 | AA891537 | EST195340 cDNA | 2420 ± 94 | 1098 ± 85 | 2145 ± 96 | -1.13 | 0.0468 |
| SEQ ID NO: 390 | AA799680 | EST189177 cDNA | 560 ± 45 | 544 ± 33 | 431 ± 39 | -1.30 | 0.0504 |
| Correlate with SWM | | | | | | | |
| SEQ ID NO: 391 | AA893199 | EST197002 cDNA | 2422 ± 100 | 2482 ± 67 | 2129 ± 112 | -1.14 | 0.0287 |
| SEQ ID NO: 392 | AA799636 | EST189133 cDNA | 3279 ± 92 | 2986 ± 125 | 2826 ± 124 | -1.16 | 0.0358 |
| SEQ ID NO: 393 | AA874995 | UI-R-E0-cf-d-08-0-UI.s1 cDNA | 1202 ± 44 | 1123 ± 37 | 1068 ± 19 | -1.13 | 0.0360 |
| SEQ ID NO: 394 | AA892298 | EST196101 cDNA | 302 ± 26 | 243 ± 13 | 229 ± 22 | -1.32 | 0.0456 |
| SEQ ID NO: 395 | AA892538 | EST196341 cDNA | 1033 ± 64 | 902 ± 41 | 868 ± 36 | -1.19 | 0.0547 |
| No significant behavioral correlations | | | | | | | |
| SEQ ID NO: 396 | AA859690 | UI-R-E0-bx-e-11-0-UI.s1 cDNA | 297 ± 29 | 173 ± 40 | 137 ± 10 | -2.17 | 0.0017 |
| SEQ ID NO: 397 | AA875004 | UI-R-E0-cb-b-07-0-UI.s1cDNA | 965 ± 40 | 774 ± 44 | 776 ± 30 | -1.24 | 0.0022 |

TABLE 3-continued

Genes and ESTs with Significant Age-Dependent Changes in Expression Level
(ANOVA; p ≤ .05 That Did Not Appear in TABLES 1 and 2

| SEQ ID NO: | GenBank | Descriptions | Young | Mid | Age | FC | ANOVA p |
|---|---|---|---|---|---|---|---|
| SEQ ID NO: 398 | AA891037 | EST194840 cDNA | 2174 ± 98 | 1781 ± 83 | 1774 ± 68 | −1.23 | 0.0031 |
| SEQ ID NO: 399 | AA893185 | EST196988 cDNA | 7616 ± 301 | 6680 ± 137 | 6666 ± 166 | −1.14 | 0.0045 |
| SEQ ID NO: 400 | AA892511 | EST196314 cDNA | 4716 ± 113 | 4061 ± 150 | 4216 ± 139 | −1.12 | 0.0068 |
| SEQ ID NO: 401 | AA875129 | UI.R-E0-bu-e-01-0-UI.s2 cdna | 1214 ± 28 | 1093 ± 33 | 1062 ± 34 | −1.14 | 0.0071 |
| SEQ ID NO: 402 | AA800693 | EST190190 cDNA | 3177 ± 84 | 2844 ± 82 | 2830 ± 71 | −1.12 | 0.0072 |
| SEQ ID NO: 403 | AA859562 | UI-R-E0-bv-b-03-0-UI.s1 cDNA | 933 ± 91 | 682 ± 57 | 606 ± 58 | −1.54 | 0.0078 |
| SEQ ID NO: 404 | AA860030 | UI-R-E0-bz-e-07-0-UI.s2 cDNA | 20727 ± 774 | 17601 ± 811 | 17941 ± 508 | −1.16 | 0.0090 |
| SEQ ID NO: 405 | AA891727 | EST195530 cDNA | 5801 ± 266 | 4821 ± 204 | 5038 ± 189 | −1.15 | 0.0114 |
| SEQ ID NO: 406 | AA892796 | EST196599 cDNA | 6952 ± 143 | 6326 ± 167 | 6441 ± 110 | −1.08 | 0.0117 |
| SEQ ID NO: 407 | AI639477 | mixed-tissue library cDNA clone rx02351 3 | 264 ± 26 | 193 ± 53 | 78 ± 40 | −3.39 | 0.0154 |
| SEQ ID NO: 408 | AA893717 | EST197520 cDNA | 515 ± 24 | 442 ± 35 | 386 ± 27 | −1.33 | 0.0179 |
| SEQ ID NO: 409 | AA892414 | EST196217 cDNA | 2935 ± 143 | 2507 ± 111 | 2511 ± 79 | −1.17 | 0.0185 |
| SEQ ID NO: 156 | AA893743 | EST197546 cDNA | 2730 ± 120 | 2282 ± 121 | 2181 ± 154 | −.125 | 0.0193 |
| SEQ ID NO: 410 | AI176491 | EST220076 cDNA | 5180 ± 138 | 4665 ± 213 | 4450 ± 108 | −1.16 | 0.0199 |
| SEQ ID NO: 411 | AA799481 | EST188978 cDNA | 1036 ± 33 | 889 ± 31 | 916 ± 44 | −1.13 | 0.0240 |
| SEQ ID NO: 412 | AA859643 | UI-R-E0-bs-a-08-0-UI.s1 cDNA | 4772 ± 162 | 3978 ± 177 | 4165 ± 238 | −1.15 | 0.0252 |
| SEQ ID NO: 413 | AA875257 | UI-R-E0-cq-d-12-0-UI.s1 cDNA | 1715 ± 133 | 1369 ± 92 | 1342 ± 71 | −1.28 | 0.0255 |
| SEQ ID NO: 414 | AA685974 | EST108806 cDNA | 5543 ± 142 | 4855 ± 194 | 4974 ± 184 | −1.11 | 0.0275 |
| SEQ ID NO: 415 | AA891476 | EST195279 cDNA | 7512 ± 289 | 7075 ± 235 | 6520 ± 208 | −1.15 | 0.0279 |
| SEQ ID NO: 416 | AA891950 | EST195753 cDNA | 865 ± 18 | 818 ± 45 | 725 ± 33 | −1.19 | 0.0284 |
| SEQ ID NO: 417 | AA875019 | UI-R-E0-cb-f-08-0-UI.s1 cDNA | 1007 ± 32 | 908 ± 29 | 901 ± 29 | −1.12 | 0.0357 |
| SEQ ID NO: 418 | AA866477 | UI-R-E0-br-h-03-0-UI.s1 cDNA | 11037 ± 230 | 9932 ± 341 | 10208 ± 283 | −1.08 | 0.0376 |
| SEQ ID NO: 419 | AI639209 | mixed-tissue library cDNA clone rx00680 3 | 763 ± 57 | 820 ± 98 | 562 ± 44 | −1.36 | 0.0385 |
| SEQ ID NO: 420 | AI102868 | EST212157 cDNA | 11364 ± 316 | 9876 ± 516 | 9787 ± 490 | −1.16 | 0.0418 |
| SEQ ID NO: 421 | AI178204 | EST221869 cDNA | 2465 ± 180 | 2162 ± 137 | 1905 ± 122 | −1.29 | 0.0419 |
| SEQ ID NO: 422 | AA799858 | EST189355 cDNA | 1068 ± 76 | 925 ± 58 | 827 ± 58 | −1.29 | 0.0427 |
| SEQ ID NO: 423 | AA800026 | EST189523 cDNA | 249 ± 29 | 155 ± 26 | 144 ± 35 | −1.73 | 0.0429 |
| SEQ ID NO: 424 | AA892637 | EST196440 cDNA | 809 ± 16 | 757 ± 24 | 739 ± 16 | −1.10 | 0.0430 |
| SEQ ID NO: 425 | AA859545 | ESTs, Weakly similar to hypothetical protein C09H6.3 | 3289 ± 167 | 2762 ± 137 | 2876 ± 134 | −1.14 | 0.0442 |
| SEQ ID NO: 426 | AA859848 | UI-R-E0-cc-h-10-0-UI.s1 cDNA | 3396 ± 315 | 3150 ± 165 | 2626 ± 129 | −1.29 | 0.0456 |
| SEQ ID NO: 427 | H33086 | EST108750 cDNA | 21205 ± 763 | 18706 ± 530 | 19138 ± 810 | −1.11 | 0.0477 |
| SEQ ID NO: 428 | AA893224 | EST197027 cDNA | 2325 ± 67 | 2150 ± 75 | 2076 ± 64 | −1.12 | 0.0502 |
| ESTs, Increased | | | | | | | |
| Correlate with both OMT and SWM | | | | | | | |
| SEQ ID NO: 429 | AA893946 | EST197749 cDNA | 371 ± 45 | 565 ± 43 | 544 ± 72 | 1.47 | 0.0440 |
| Correlate with OMT | | | | | | | |
| SEQ ID NO: 430 | AI638997 | mixed-tissue library cDNA clone rx05048 3 | 402 ± 23 | 450 ± 26 | 483 ± 11 | 1.20 | 0.0381 |
| SEQ ID NO: 431 | AI177404 | EST221024 cDNA | 1012 ± 46 | 1193 ± 73 | 1245 ± 65 | 1.23 | 0.0429 |
| Correlate with SWM | | | | | | | |
| SEQ ID NO: 432 | AA800318 | EST189815 cDNA | 315 ± 46 | 376 ± 40 | 474 ± 41 | 1.51 | 0.0421 |
| No significant behavioral correlations | | | | | | | |
| SEQ ID NO: 433 | AA893082 | EST196885 cDNA | 1454 ± 95 | 1902 ± 43 | 1865 ± 110 | 1.28 | 0.0021 |
| SEQ ID NO: 434 | AA892986 | EST196789 cDNA | 586 ± 19 | 627 ± 33 | 756 ± 39 | 1.29 | 0.0025 |
| SEQ ID NO: 435 | M13100 | long interspersed repetitive DNA sequence LINE3 | 4328 ± 230 | 5963 ± 252 | 5947 ± 457 | 1.37 | 0.0026 |
| SEQ ID NO: 436 | AA891734 | EST195537 cDNA | 1648 ± 86 | 1778 ± 82 | 2045 ± 60 | 1.24 | 0.0037 |
| SEQ ID NO: 437 | AI171966 | ESTs, Highly similar to selenide, water dikinase 2 | 880 ± 42 | 934 ± 30 | 1181 ± 93 | 1.34 | 0.0049 |
| SEQ ID NO: 438 | AI639151 | mixed-tissue library cDNA clone rx02802 3 | 939 ± 49 | 1192 ± 80 | 1223 ± 54 | 1.30 | 0.0083 |
| SEQ ID NO: 439 | AA875037 | UI-R-E0-cb-a-03-0.UI.s1 cDNA | 11 ± 71 | 268 ± 70 | 357 ± 78 | 5.84 | 0.0084 |
| SEQ ID NO: 440 | AA891690 | ESTs, Weakly similar to p-serine aminotransferase | 1858 ± 76 | 1955 ± 65 | 2296 ± 131 | 1.24 | 0.0088 |
| SEQ ID NO: 86 | AA891810 | EST195613 cDNA | 1504 ± 140 | 2028 ± 155 | 2274 ± 202 | 1.51 | 0.0125 |
| SEQ ID NO: 441 | AA866432 | UI-R-E0-ch-e-06-0-UI.s1 cDNA | 277 ± 150 | 3380 ± 102 | 3493 ± 226 | 1.26 | 0.0143 |
| SEQ ID NO: 442 | X05472 | 2.4 kb repeat DNA right terminal region | 4188 ± 565 | 5325 ± 564 | 7241 ± 899 | 1.73 | 0.0173 |
| SEQ ID NO: 443 | AA892146 | EST195949 cDNA | 5386 ± 450 | 7073 ± 436 | 7004 ± 418 | 1.30 | 0.0187 |
| SEQ ID NO: 444 | AA852046 | EST194815 cDNA | 1697 ± 140 | 2163 ± 92 | 2051 ± 112 | 1.21 | 0.0234 |
| SEQ ID NO: 445 | AA799396 | EST188893 cDNA | 163 ± 26 | 264 ± 35 | 269 ± 24 | 1.65 | 0.0275 |
| SEQ ID NO: 446 | AI638971 | mixed-tissue library cDNA clone rx04989 3 | 128 ± 26 | 188 ± 13 | 213 ± 24 | 1.67 | 0.0285 |
| SEQ ID NO: 194 | AA892520 | EST196323 cDNA | 479 ± 31 | 526 ± 28 | 601 ± 33 | 1.25 | 0.0305 |
| SEQ ID NO: 447 | AA891774 | EST195577 cDNA | −518 ± 92 | −115 ± 126 | −147 ± 108 | 1.00 | 0.0322 |

TABLE 3-continued

Genes and ESTs with Significant Age-Dependent Changes in Expression Level
(ANOVA; p ≦ .05 That Did Not Appear in TABLES 1 and 2)

| SEQ ID NO: | GenBank | Descriptions | Young | Mid | Age | FC | ANOVA p |
|---|---|---|---|---|---|---|---|
| SEQ ID NO: 435 | M13100 | long interspersed repetitive DNA sequence LINE3 | 8845 ± 982 | 12115 ± 1117 | 12282 ± 814 | 1.39 | 0.0366 |
| SEQ ID NO: 448 | AI639257 | mixed-tissue library cDNA clone rx-1119 3 | 172 ± 23 | 306 ± 41 | 286 ± 41 | 1.66 | 0.0386 |
| SEQ ID NO: 449 | AA866299 | UI-R_A0-ac-f-12-0-UI.s3 cDNA | 684 ± 45 | 810 ± 24 | 885 ± 73 | 1.29 | 0.0390 |
| SEQ ID NO: 450 | AA799773 | EST189270 cDNA | 299 ± 30 | 408 ± 24 | 433 ± 50 | 1.45 | 0.0407 |
| SEQ ID NO: 449 | AA866299 | UI-R-A0-ac-f-12-0-UI.s3 cDNA | 522 ± 32 | 623 ± 28 | 626 ± 31 | 1.20 | 0.0415 |
| SEQ ID NO: 451 | AA891944 | EST195747 cDNA | 193 ± 15 | 198 ± 13 | 247 ± 20 | 1.28 | 0.0488 |

Using the method of the invention, we have identified a set of genes and ESTs that changed with age by ANOVA (p≦0.05), but which are not ACGs. These include AA685974 (EST108806 cDNA) (SEQ ID NO:414); AA799396 (EST188893 cDNA) (SEQ ID NO:445); AA799479 (ESTs, Highly similar to NADH-ubiquinone oxidoreduct.) (SEQ ID NO:295); AA799481 (EST188978 cDNA) (SEQ ID NO:411); AA799529 (EST189026 cDNA) (SEQ ID NO:382); AA799599 (EST189096 cDNA) (SEQ ID NO:380); AA799636 (EST189133 cDNA) (SEQ ID NO:392); AA799680 (EST189177 cDNA) (SEQ ID NO:390); AA799724 (ESTs, Highly similar to DNA-directed RNA polymeraseI) (SEQ ID NO:199); AA799773 (EST189270 cDNA) (SEQ ID NO:450); AA799779 (acyl-CoA:dihydroxyacetonephosphate acyltransferase) (SEQ ID NO:221); AA799858 (EST189355 cDNA) (SEQ ID NO:422); AA800026 (EST189523 cDNA) (SEQ ID NO:423); AA800318 (EST189815 cDNA) (SEQ ID NO:432); AA800622 (EST190119 cDNA) (SEQ ID NO:385); AA800693 (EST190190 cDNA) (SEQ ID NO:402); AA800948 (Tuba4) (SEQ ID NO:233); AA801286 (Inositol (myo)-1 (or 4)-monophosphatase 1) (SEQ ID NO:265); AA817887 (profilin) (SEQ ID NO:291); AA818025 (CD59 antigen) (SEQ ID NO:85); AA818240 (Nuclear pore complex protein) (SEQ ID NO:312); AA818487 (cyclophilin B) (SEQ ID NO:294); AA819500 (ESTs, Highly similar to AC12_HUMAN 37 kD subunit) (SEQ ID NO:283); AA819708 (Cox7a3) (SEQ ID NO:247); AA848831 (lysophosphatidic acid G-protein-coupled receptor, 2) (SEQ ID NO:328); AA852046 (EST194815 cDNA) (SEQ ID NO:444); AA859545 (ESTs, Weakly similar to hypothetical protein C09H6.3) (SEQ ID NO:425); AA859562 (UI-R-E0-bv-b-03-0-UI.s1 cDNA) (SEQ ID NO:403); AA859643 (UI-R-E0-bs-a-08-0-UI.s1 cDNA) (SEQ ID NO:412); AA859645 (attractin) (SEQ ID NO:346); AA859690 (UI-R-E0-bx-e-11-0-UI.s1 cDNA) (SEQ ID NO:396); AA859848 (UI-R-E0-cc-h-10-0-UI.s1 cDNA) (SEQ ID NO:426); AA859954 (Vacuole Membrane Protein 1) (SEQ ID NO:271); AA859980 (T-complex 1) (SEQ ID NO:278); AA860030 (UI-R-E0-bz-e-07-0-UI.s2 cDNA) (SEQ ID NO:404); AA866257 (ESTs) (SEQ ID NO:248); AA866299 (UI-R-A0-ac-f-12-0-UI.s3 cDNA) (SEQ ID NO:449); AA866432 (UI-R-E0-ch-e-06-0-UI.s1 cDNA)_ (SEQ ID NO:441); AA866477 (UI-R-E0-br-h-03-0-UI.s1 cDNA) (SEQ ID NO:418); AA874830 (UI-R-E0-cg-f-04-0-UI.s1 cDNA) (SEQ ID NO:378); AA874874 (ESTs, Highly similar to alcohol dehydrogenase class III) (SEQ ID NO:258); AA874969 (ESTs, Highly similar to c-Jun leucine zipper interactive) (SEQ ID NO:263); AA874995 (UI-R-E0-cf-d-08-0-UI.s1 cDNA) (SEQ ID NO:393); AA875004 (UI-R-E0-cb-b-07-0-UI.s1 cDNA) (SEQ ID NO:397); AA875019 (UI-R-E0-cb-f-08-0-UI.s1 cDNA) (SEQ ID NO:417); AA875032 (UI-R-E0-cb-h-09-0-UI.s1 cDNA) (SEQ ID NO:379); AA875037 (UI-R-E0-cb-a-03-0-UI.s1 cDNA) (SEQ ID NO:439); AA875129 (UI-R-E0-bu-e-01-0-UI.s2 cDNA) (SEQ ID NO:401); AA875257 (UI-R-E0-cq-d-12-0-UI.s1 cDNA) (SEQ ID NO:413); AA891037 (EST194840 cDNA) (SEQ ID NO:398); AA891041 (jun B proto-oncogene) (SEQ ID NO:290); AA891221 (EST195024 cDNA) (SEQ ID NO:387); AA891476 (EST195279 cDNA) (SEQ ID NO:415); AA891537 (EST195340 cDNA) (SEQ ID NO:389); AA891690 (ESTs, Weakly similar to p-serine aminotransferase) (SEQ ID NO:440); AA891727 (EST195530 cDNA) (SEQ ID NO:405); AA891734 (EST195537 cDNA) (SEQ ID NO:436); AA891774 (EST195577 cDNA) (SEQ ID NO:447); AA891810 (EST195613 cDNA) (SEQ ID NO:86); AA891880 (Loc65042) (SEQ ID NO:243); AA891916 (membrane interacting protein of RGS16) (SEQ ID NO:209); AA891944 (EST195747 cDNA) (SEQ ID NO:451); AA891950 (EST195753 cDNA) (SEQ ID NO:416); AA892146 (EST195949 cDNA) (SEQ ID NO:443); AA892298 (EST196101 cDNA) (SEQ ID NO:394); AA892414 (EST196217 cDNA) (SEQ ID NO:409); AA892511 (EST196314 cDNA) (SEQ ID NO:400); AA892520 (EST196323 cDNA) (SEQ ID NO:194); AA892538 (EST196341 cDNA) (SEQ ID NO:395); AA892637 (EST196440 cDNA) (SEQ ID NO:424); AA892775 (Lysozyme) (SEQ ID NO:354); AA892796 (EST196599 cDNA) (SEQ ID NO:406); AA892813 (EST196616 cDNA) (SEQ ID NO:381); AA892986 (EST196789 cDNA) (SEQ ID NO:434); AA893082 (EST196885 cDNA) (SEQ ID NO:433); AA893185 (EST196988 cDNA) (SEQ ID NO:399); AA893199 (EST1197002 cDNA) (SEQ ID NO:391); AA893224 (EST197027 cDNA) (SEQ ID NO:428); AA893320 (EST197123 cDNA) (SEQ ID NO:388); AA893584 (EST197387 cDNA) (SEQ ID NO:383); AA893690 (EST197493 cDNA) (SEQ ID NO:386); AA893708 (KIAA0560) (SEQ ID NO:227); AA893717 (EST197520 cDNA) (SEQ ID NO:408); AA893743 (EST197546 cDNA) (SEQ ID NO:156); AA893788 (ESTs, Highly similar to chromobox protein homolog 5) (SEQ ID NO:299); AA893946 (EST197749 cDNA) (SEQ ID NO:429); AA894305 (EST198108 cDNA) (SEQ ID NO:384); AA924925 (ER transmembrane protein Dri 42) (SEQ ID NO:372); AA942685 (cytosolic cysteine dioxygenase 1) (SEQ ID NO:249); AA955306 (ras-related protein rab10) (SEQ ID NO:365); AA955388 ($Na^+K^+$ transporting ATPase 2, beta polypeptide 2) (SEQ ID NO:307); AA957132 (N-acetylglucosaminyltransferase I) (SEQ ID NO:375); AB000778 (Phoshpolipase D gene 1) (SEQ ID NO:357); AB006451 (Tim23) (SEQ ID NO:253); AB008538 (HB2) (SEQ ID NO:324); AB016532 (period homolog 2 (Drosophila)) (SEQ ID NO:259); AF000899 (p58/p45, nucleolin) (SEQ ID NO:286); AF007554 (Mucin1) (SEQ ID NO:266); AF007758 (synuclein, alpha) (SEQ ID NO:260); AF007790 (resection-induced TPI (rs11)) (SEQ ID NO:262); AF008554 (implantation-associated protein (IAG2)) (SEQ ID NO:331); AF013144 (MAP-kinase phosphatase (cpg21)) (SEQ ID NO:281); AF016269 (kallikrein 6 (neurosin, zyme)) (SEQ ID NO:301); AF016296 (neuropilin) (SEQ ID NO:325); AF019974 (Chromogranin B, parathyroid secretory protein) (SEQ ID NO:223); AF020046 (integrin alpha E1, epithelial-associated) (SEQ ID NO:284); AF021935 (Ser-Thr protein kinase) (SEQ ID NO:302); AF023087 (Early growth response 1) (SEQ ID NO:269); AF030050 (replication factor C) (SEQ ID NO:327); AF030088 (RuvB-like protein 1) (SEQ ID NO:280); AF040954 (putative protein phosphatase1 nuclear targeting subunit) (SEQ ID NO:213); AF051561 (solute carrier family 12, member 2) (SEQ ID NO:322); AF055477 (L-type voltage-dependent $Ca^{2+}$ channel (?1D subunit)) (SEQ ID NO:207); AF074608 (MHC class 1 antigen (RT1.EC2) gene) (SEQ ID NO:340); AF076183 (cytosolic sorting protein PACS-1a (PACS-1)) (SEQ ID NO:231); AF095927 (protein phosphatase 2C) (SEQ ID NO:246); AI010110 (SH3-domain GRB2-like 1) (SEQ ID NO:273); AI012589 (glutathione S-transferase, pi 2) (SEQ ID NO:356); AI013627 (defender against cell death 1) (SEQ ID NO:208); AI013861 (3-hydroxyisobutyrate dehydrogenase) (SEQ ID NO:342); AI045249 (heat shock 70 kD protein 8) (SEQ ID NO:245); AI102031 (myc box dependent interacting protein 1) (SEQ ID NO:370); AI102299 (Bid3) (SEQ ID NO:320); AI102839 (cerebellar Ca-binding protein, spot 35 protein) (SEQ ID NO:203); AI102868 (EST212157 cDNA) (SEQ ID NO:420); AI104388 (heat shock 27 kD protein 1) (SEQ ID NO:296); AI136891 (zinc finger protein 36, C3H type-like 1) (SEQ ID NO:275); AI168942 (branched chain keto acid dehydrogenase E1) (SEQ ID NO:268); AI169265 (Atp6s1) (SEQ ID NO:219); AI171966 (ESTs, Highly similar to selenide, water dikinase 2) (SEQ ID NO:437); AI175973 (ESTs, Highly similar to NADH dehydrogenase) (SEQ ID NO:198); AI176491 (EST220076 cDNA) (SEQ ID NO:410); AI176595 (Cathepsin L) (SEQ ID NO:351); AI176621 (iron-responsive element-binding protein) (SEQ ID NO:272); AI177404 (EST221024 cDNA) (SEQ ID NO:431); AI178204 (EST221869 cDNA) (SEQ ID NO:421); AI178921 (Insulin degrading enzyme) (SEQ ID NO:215); AI228548 (ESTs, Highly similar to DKFZp586G0322.1) (SEQ ID NO:316); AI230247 (selenoprotein P, plasma, 1) (SEQ ID NO:300); AI230778 (ESTs, Highly similar to protein-tyrosine sulfotrans. 2) (SEQ ID NO:277); AI230914 (farnesyltransferase beta subunit) (SEQ ID NO:229); AI231807 (ferritin light chain 1) (SEQ ID NO:332); AI232268 (LDL receptor-related protein associated protein 1) (SEQ ID NO:244); AI235344 (geranylgeranyltransferase type I (GGTase-1)) (SEQ ID NO:304); AI237007 (ESTs, Highly similar to flavoprot.-ubiquin. Oxidoreduct.) (SEQ ID NO:376); AI638971 (mixed-tissue library cDNA clone rx04989 3) (SEQ ID NO:446); AI638997 (mixed-tissue library cDNA clone rx05048 3) (SEQ ID NO:430); AI639151 (mixed-tissue library cDNA clone rx02802 3) (SEQ ID NO:438); AI639209 (mixed-tissue library cDNA clone rx00680 3) (SEQ ID NO:419); AI639257 (mixed-tissue library cDNA clone rx01119 3) (SEQ ID NO:448); AI639477 (mixed-tissue library cDNA clone rx02351 3) (SEQ ID NO:407); D00569 (2,4-dienoyl CoA reductase 1, mitochondrial) (SEQ ID NO:311); D10262 (choline kinase) (SEQ ID NO:214); D10699 (ubiquitin carboxy-terminal hydrolase L1) (SEQ ID NO:234); D10854 (aldehyde reductase) (SEQ ID NO:285); D10874 (lysosomal vacuolar proton pump (16 kDa)) (SEQ ID NO:211); D16478 (mitochondrial long-chain enoyl-CoA hydratase) (SEQ ID NO:250); D17309 (delta 4-3-ketosteroid-5-beta-reductase) (SEQ ID NO:364); D28110 (myelin-associated oligodendrocytic basic protein) (SEQ ID NO:309); D28557 (cold shock domain protein A) (SEQ ID NO:313); D29766 (v-crk-associated tyrosine kinase substrate) (SEQ ID NO:202); D37951 (MIBP1 (c-myc intron binding protein 1)) (SEQ ID NO:230); D45247 (proteasome subunit RCX) (SEQ ID NO:212); D45249 (protease (prosome, macropain) 28 subunit, alpha) (SEQ ID NO:338); D78308 (calreticulin) (SEQ ID NO:293); D83948 (adult liver S1-1 protein) (SEQ ID NO:298); D88586 (eosinophil cationic protein) (SEQ ID NO:251); D89340 (dipeptidylpeptidase III) (SEQ ID NO:222); D89730 (Fibulin 3, fibulin-like extracellular matrix protein 1) (SEQ ID NO:344); D90211 (Lysosomal-associated membrane protein 2) (SEQ ID NO:345); E03229 (cytosolic cysteine dioxygenase 1) (SEQ ID NO:252); H33086 (EST108750 cDNA) (SEQ ID NO:427); H33725 (associated molecule with the SH3 domain of STAM) (SEQ ID NO:228); J02752 (acyl-coA oxidase) (SEQ ID NO:368); J02773 (heart fatty acid binding protein) (SEQ ID NO:289); J05022 (peptidylarginine deiminase) (SEQ ID NO:362); J05031 (Isovaleryl Coenzyme A dehydrogenase) (SEQ ID NO:288); J05132 (UDP-glucuronosyltransferase) (SEQ ID NO:330); K02248 (Somatostatin) (SEQ ID NO:270); L00191 (Fibronectin 1) (SEQ ID NO:350); L13202 (RATHFH2 HNF-3/fork-head homolog-2 (HFH-2)) (SEQ ID NO:220); L19998 (sulfotransferase family 1A, phenol-preferring, member 1) (SEQ ID NO:321); L24896 (glutathione peroxidase 4) (SEQ ID NO:318); L25605 (Dynamin 2) (SEQ ID NO:349); L26292 (Kruppel-like factor 4 (gut)) (SEQ ID NO:218); L29573 (neurotransmitter transporter, noradrenalin) (SEQ ID NO:216); L42855 (transcription elongation factor B (SIII) polypeptide 2) (SEQ ID NO:274); M10068 (NADPH-cytochrome P-450 oxidoreductase) (SEQ ID NO:254); M13100 (long interspersed repetitive DNA sequence LINE3) (SEQ ID NO:435); M19936 (Prosaposin-sphingolipid hydrolase activator) (SEQ ID NO:366); M23601 (Monoamine oxidase B) (SEQ ID NO:361); M24104 (synaptobrevin 2) (SEQ ID NO:303); M24104 (Vesicle-associated membrane protein (synaptobrevin 2)) (SEQ ID NO:303); M24852 (Neuron specific protein PEP-19 (Purkinje cell protein 4)) (SEQ ID NO:239); M31174 (thyroid hormone receptor alpha) (SEQ ID NO:264); M36453 (Inhibin, alpha) (SEQ ID NO:206); M55015 (nucleolin) (SEQ ID NO:348); M57276 (Leukocyte antigen (Ox-44)) (SEQ ID NO:367); M58404 (thymosin, beta 10) (SEQ ID NO:282); M80550 (adenylyl cyclase) (SEQ ID NO:204); M83745 (Protein convertase subtilisin/kexin, type I) (SEQ ID NO:226); M89646 (ribosomal protein S24) (SEQ ID NO:371); M91234 (VL30 element) (SEQ ID NO:329); M93273 (somatostatin receptor subtype 2) (SEQ ID NO:197); M93669 (Secretogranin II) (SEQ ID NO:256); M99485 (Myelin oligodendrocyte glycoprotein) (SEQ ID NO:360); S53527 (S100 calcium-binding protein, beta (neural)) (SEQ ID NO:343); S61868 (Ryudocan/syndecan 4) (SEQ ID NO:334); S72594 (tissue inhibitor of metalloproteinase 2) (SEQ ID NO:333); S77492 (Bone morphogenetic protein 3) (SEQ ID NO:276); S77858 (non-muscle myosin alkali light chain) (SEQ ID NO:287); U04738 (Somatostatin receptor subtype 4) (SEQ ID NO:261); U07619 (Coagulation factor III (thromboplastin, tissue factor)) (SEQ ID NO:377); U08259 (Glutamate receptor, N-methyl D-aspartate 2C) (SEQ ID NO:323); U10357 (pyruvate dehydrogenase kinase 2 subunit p45 (PDK2)) (SEQ ID NO:310); U14950 (tumor suppressor homolog (synapse associ. protein)) (SEQ ID NO:306); U17254 (immediate early gene transcription factor NGFI-B) (SEQ ID NO:225); U18771 (Ras-related protein Rab-26) (SEQ ID NO:205); U27518 (UDP-glucuronosyltransferase) (SEQ ID NO:279); U28938 (receptor-type protein tyrosine phosphatase D30) (SEQ ID NO:242); U38379 (Gamma-glutamyl hydrolase) (SEQ ID NO:292); U38801 (DNA polymerase beta) (SEQ ID NO:257); U67080 (r-MyT13) (SEQ ID NO:341); U67136 (A kinase (PRKA) anchor protein 5) (SEQ ID NO:336); U67137 (guanylate kinase associated protein) (SEQ ID NO:339); U72620 (Lot1) (SEQ ID NO:224); U75405 (procollagen, type I, alpha 1) (SEQ ID NO:217); U75917 (clathrin-associated protein 17) (SEQ ID NO:240); U77777 (interleukin 18) (SEQ ID NO:319); U78517 (cAMP-regulated guanine nucleotide exchange factor II) (SEQ ID NO:369); U89905 (alpha-methylacyl-CoA racemase) (SEQ ID NO:238); V01244 (Prolactin) (SEQ ID NO:317); X02904 (glutathione S-transferase P subunit) (SEQ ID NO:355); X05472 (2.4 kb repeat DNA right terminal region) (SEQ ID NO:442); X06769 (FBJ v-fos oncogene homolog) (SEQ ID NO:200); X06916 (S100 calcium-binding protein A4) (SEQ ID NO:335); X13905 (ras-related rab1B protein) (SEQ ID NO:315); X14323 (Fc receptor, IgG, alpha chain transporter) (SEQ ID NO:352); X16933 (RNA binding protein p45AUF1) (SEQ ID NO:373); X53427 (glycogen synthase kinase 3 alpha (EC 2.7.1.37)) (SEQ ID NO:241); X53504 (ribosomal protein L12) (SEQ ID NO:139); X54467 (cathepsin D) (SEQ ID NO:314); X55153 (ribosomal protein P2) (SEQ ID NO:347); X57281 (Glycine receptor alpha 2 subunit) (SEQ ID NO:235); X58294 (carbonic anhydrase 2) (SEQ ID NO:359); X59737 (ubiquitous mitochondrial creatine kinase) (SEQ ID NO:297); X60212 (ASI homolog of bacterial ribosomal subunit protein L22) (SEQ ID NO:305); X62950 (pBUS30 with repetitive elements) (SEQ ID NO:326); X67805 (Synaptonemal complex protein 1) (SEQ ID NO:210); X72757 (cox VIa gene (liver)) (SEQ ID NO:374); X74226 (LL5 protein) (SEQ ID NO:353); X76489 (CD9 cell surface glycoprotein) (SEQ ID NO:308); X76985 (latexin) (SEQ ID NO:236); X82445 (nuclear distribution gene C homolog (*Aspergillus*)) (SEQ ID NO:232); X84039 (lumican) (SEQ ID NO:237); X89696 (TPCR06 protein) (SEQ ID NO:201); X97443 (integral membrane protein Tmp21-I (p23)) (SEQ ID NO:358); X98399 (solute carrier family 14, member 1) (SEQ ID NO:267); Y17295 (thiol-specific antioxidant protein (1-Cys peroxiredoxin)) (SEQ ID NO:337); Z48225 (protein synthesis initiation factor eIF-2B delta subunit) (SEQ ID NO:255); Z49858 (plasmolipin) (SEQ ID NO:363).

Using the method of the invention, we have also identified a set of genes and ESTs that changed with age ($p \leq 0.05$), but which are correlated with cognitive performance in behavioral tests. These include L03294 (Lpl, lipoprotein lipase) (SEQ ID NO:37); M18416 (Egr1, Early growth response 1 (Krox-24)) (SEQ ID NO:8); S68245 (Ca4, carbonic anhydrase 4) (SEQ ID NO:38); M64780 (Agrn, Agrin) (SEQ ID NO:1); M27207 (Col1a1, Procollagen-type 1 (alpha 1)) (SEQ ID NO:32); X16554 (Prps1, Phosphoribosyl pyrophosphate synthetase 1) (SEQ ID NO:51); M92433 (NGFI-C, Zinc-finger transcription factor (early response gene)) (SEQ ID NO:9); AA859975 (LOC64201, 2-oxoglutarate carrier) (SEQ ID NO:39); L08595 (Nuclear receptor subfamily 4, group A, member 2) (SEQ ID NO:10); M24542 (RISP, Rieske iron-sulfur protein) (SEQ ID NO:40); AI030089 (Nopp130, nucleolar phosphoprotein p130) (SEQ ID NO:11); AF104362 (Omd, Osteomodulin (osteoadherin)) (SEQ ID NO:33); L46873 (Slc15a1, Oligopeptide transporter) (SEQ ID NO:47); AI176689 (MAPKK 6, mitogen-activated protein kinase kinase 6) (SEQ ID NO:19); U66470 (rCGR11, Cell growth regulator) (SEQ ID NO:52); AF016387 (RXRG, retinoid X-receptor gamma) (SEQ ID NO:12); M18467 (Got2, glutamate oxaloacetate transaminase 2) (SEQ ID NO:41); X54793 (Hsp60, heat shock protein 60) (SEQ ID NO:62); X64401 (Cyp3a3, Cytochrome P450-subfamily 111A (polypeptide 3)) (SEQ ID NO:42); M37584 (H2afz, H2A histone family (member Z)) (SEQ ID NO:53); L21192 (GAP-43, membrane attached signal protein 2 (brain)) (SEQ ID NO:2); AA875047 (TCPZ, T-complex protein 1 (zeta subunit)) (SEQ ID NO:63); U90610 (Cxcr4, CXC chemokine receptor) (SEQ ID NO:54); AF003904 (CRH-binding protein) (SEQ ID NO:27); U83880 (GPDH-M, glycerol-3-phosphate dehydrogenase, mitochondrial) (SEQ ID NO:43); X89703 (TPCR19, Testis Polymerase Chain Reaction product 19) (SEQ ID NO:20); D63886 (MMP16, matrix metalloproteinase 16) (SEQ ID NO:34); J05499 (GLS, glutaminase (mitochondrial)) (SEQ ID NO:44); D21799 (Psmb2, Proteasome subunit (beta type 2)) (SEQ ID NO:64); AA800794 (HT2A, zinc-finger protein) (SEQ ID NO:13); U90887 (Arg2, arginase type II) (SEQ ID NO:45); S82649 (Narp, neuronal activity-regulated pentraxin) (SEQ ID NO:3); M74223 (VGF, neurosecretory protein) (SEQ ID NO:4); AA874794 (Bex3, brain expressed X-linked 3) (SEQ ID NO:55); M15191 (Tac1, Tachykinin) (SEQ ID NO:28); AA892506 (coronin, actin binding protein 1A) (SEQ ID NO:56); L04485 (MAPPK1, mitogen-activated protein kinase kinase 1) (SEQ ID NO:21); AA799641 (S164, Contains a PWI domain associated with RNA splicing) (SEQ ID NO:14); AA817892 (Gnb2, Guanine nucleotide binding protein (beta 2 subunit)) (SEQ ID NO:22); AA893939 (DSS1, deleted in split hand/split foot protein 1) (SEQ ID NO:57); AF000901 (P581P45, Nucleoporin p58) (SEQ ID NO:23); AF087037 (Btg3, B-cell translocation gene 3) (SEQ ID NO:58); AB000280 (PHT1, peptide/histidine transporter) (SEQ ID NO:48); M87854 (Beta-ARK-1, beta adrenergic receptor kinase 1) (SEQ ID NO:24); U06099 (Prdx2, Peroxiredoxin 2) (SEQ ID NO:59); AF058795 (Gb2, GABA-B receptor) (SEQ ID NO:25); AA800517 (VAP1, vesicle associated protein) (SEQ ID NO:26); U63740 (Fez1, Protein kinase C-binding protein Zeta1) (SEQ ID NO:5); U53922 (Hsj2, DnaJ-like protein (RDJ1)) (SEQ ID NO:65); U78102 (Egr2, Early growth response 2) (SEQ ID NO:15); U44948 (SmLIM, smooth muscle cell LIM protein) (SEQ ID NO:16); U87627 (MCT3, putative monocarboxylate transporter) (SEQ ID NO:49); AB020504 (PMF31, highly homologus to mouse F-box-WD40 repeat protein 6) (SEQ ID NO:67); M21354 (Col3a1, collagen type III alpha-1) (SEQ ID NO:35); AA893664 (Temo, sertoli cell marker (KIAA0077 protein fragment)) (SEQ ID NO:68); AB010437 (CDH8, Cadherin-8) (SEQ ID NO:36); M22756 (Ndufv2, mitochondrial NADH dehydrogenase (24 kDa)) (SEQ ID NO:46); AA799389 (Rab3B, ras-related protein) (SEQ ID NO:50); AI172476 (Tieg-1, TGF-beta-inducible early growth response protein 1) (SEQ ID NO:60); AF091563 (Olfactory receptor) (SEQ ID NO:29); M64376 (Olfactory protein) (SEQ ID NO:30); J04488 (Ptgds, Prostaglandin D synthase) (SEQ ID NO:69); X71127 (c1qb, complement component 1-q (beta polypeptide)) (SEQ ID NO:70); J03752 (Microsomal GST-1, glutathione S-transferase) (SEQ ID NO:71); J03481 (Qdpr, Dihydropteridine reductase) (SEQ ID NO:115); L40362 (MHC class I RT1.C-type protein) (SEQ ID NO:72); M94918 (Hbb, beta hemoglobin) (SEQ ID NO:125); M55534 (Cryab, alpha crystallin polypeptide 2) (SEQ ID NO:105); U17919 (Aif1, allograft inflammatory factor 1) (SEQ ID NO:73); M15562 (MHC class II RT1.u-D-alpha chain) (SEQ ID NO:74); AA799645 (Phospholemman, FXYD domain-containing ion transport regulator 1) (SEQ ID NO:130); X13044 (Cd74, CD74 antigen) (SEQ ID NO:75); M24324 (RTS, MHC class I RT1 (RTS) (u haplotype)) (SEQ ID NO:76); U31866 (Nclone10) (SEQ ID NO:126); M32062 (Fcgr3, Fc IgG receptor III (low affinity)) (SEQ ID NO:77); AF095741 (Mg87) (SEQ ID NO:151); L03201 (Ctss, cathepsin S) (SEQ ID NO:131); M27905 (Rpl21, Ribosomal protein L21) (SEQ ID NO:132); D38380 (Tf, Transferrin) (SEQ ID NO:127); AA893493 (RPL26, Ribosomal protein L26) (SEQ ID NO:133); AJ222813 (I118, interleukin 18) (SEQ ID NO:78); E13541 (Cspg5, chondroitin sulfate proteoglycan 5) (SEQ ID NO:102); X54096 (Lcat, Lecithin-cholesterol acyltransferase) (SEQ ID NO:110); L40364 (RT1Aw2, RT1 class Ib) (SEQ ID NO:79); D28111 (MOBP, myelin-associated oligodendrocytic basic protein) (SEQ ID NO:106); M32016 (Lamp2, lysosomal-associated membrane protein 2) (SEQ ID NO:142); X 13167 (NF1-A, nuclear factor 1 A) (SEQ ID NO:89); U26356 (S100A1, S100 protein (alpha chain)) (SEQ ID NO:95); AI231213 (Kangai 1, suppression of tumorigenicity 6) (SEQ ID NO:80); AI170268 (Ptgfr, Prostaglandin F receptor) (SEQ ID NO:81); X62952 (Vim, vimentin) (SEQ ID NO:119); AI014169 (Vdup1, vitamin D-upregulated) (SEQ ID NO:152); AA850219 (Anx3, Annexin A3) (SEQ ID NO:96); D84477 (Rhoa, ras-related homolog A2) (SEQ ID NO:97); X52477 (C3, Complement component 3) (SEQ ID NO:82); X52619 (Rpl28, Ribosomal protein L28) (SEQ ID NO:134); X06554 (S-MAG, myelin-associated glycoprotein C-term) (SEQ ID NO:107); Z50144 (Kat2, kynurenine aminotransferase II) (SEQ ID NO:116); X14181 (RPL18A, Ribosomal protein L18a) (SEQ ID NO:135); AA892333 (Tuba1, alpha-tubulin) (SEQ ID NO:120); U67082 (KZF-1, Kruppel associated box (KRAB) zinc finger 1) (SEQ ID NO:90); U11760 (Vcp, valosin-containing protein) (SEQ ID NO:121); AF048828 (VDAC1, voltage-dependent anion channel 1) (SEQ ID NO:98); M31076 (TNF-alpha, Transforming growth factor (alpha)) (SEQ ID NO:136); S83279 (HSDIV, 17-beta-hydroxysteroid dehydrogenase type IV) (SEQ ID NO:111); AI102103 (Pik4cb, Phosphatidylinositol 4-kinase) (SEQ ID NO:99); X56325 (Hba1, alpha 1 hemoglobin) (SEQ ID NO:128); X73371 (FCGR2, Low affinity immunoglobulin gamma Fc receptor II) (SEQ ID NO:83); X78848 (Gsta1, Glutathione-S-transferase (alpha type)) (SEQ ID NO:84); U92564 (Roaz, Olf-1/EBF associated Zn finger protein) (SEQ ID NO:91); AI171462 (Cd24, CD24 antigen) (SEQ ID NO:137); X83231 (PAIHC3, Pre-alpha-inhibitor, heavy chain 3) (SEQ ID NO:103); AF097593 (Ca4, cadherin 2-type 1 (neuronal)) (SEQ ID NO:104); X68283 (Rpl29, Ribosomal protein L29) (SEQ ID NO:138); S55427 (Pmp, peripheral myelin protein) (SEQ ID NO:108); AA818025 (Cd59, CD59 antigen) (SEQ ID NO:85); E01534 (Rps15, Ribosomal protein S15) (SEQ ID NO:143); U37138 (Sts, Steroid sulfatase) (SEQ ID NO:112); X55572 (Apod, Apolipoprotein D) (SEQ ID NO:113); AI028975 (AP-1, adaptor protein complex (beta 1)) (SEQ ID NO:144); L16995 (ADD1, adipocyte determination/differentiation-dependent factor 1) (SEQ ID NO:92); U07971 (Transamidinase, Glycine amidinotransferase, mitochondrial) (SEQ ID NO:117); L07736 (Cpt1a, Carnitine palmitoyltransferase 1 alpha (liver)) (SEQ ID NO:114); AI237535 (LitaF, LPS-induced TNF-alpha factor) (SEQ ID NO:93); AI175486 (Rps7, Ribosomal protein S7) (SEQ ID NO:145); U32498 (RSEC8, rat homolog of yeast sec8) (SEQ ID NO:122); X53504 (RPL12, Ribosomal protein L12) (SEQ ID NO:139); AF023621 (Sort1, sortilin) (SEQ ID NO:146); AF083269 (P41-Arc, actin-related protein complex 1b) (SEQ ID NO:123); AA891810 (GST, Glutathione S-transferase) (SEQ ID NO:86); M77694 (Fah, fumarylacetoacetate hydrolase) (SEQ ID NO:118); M22357 (MAG, myelin-associated glycoprotein) (SEQ ID NO:109); AI230712 (Pace4, Subtilisin-like endoprotease) (SEQ ID NO:147); AF008439 (NRAMP2, Natural resistance-associated macrophage protein 2) (SEQ ID NO:129); U77829 (Gas-5, growth arrest homolog) (SEQ ID NO:140); U92081 (Gp38, Glycoprotein 38) (SEQ ID NO:87); AA891445 (Skd3, suppressor of $K^+$ transport defect 3) (SEQ ID NO:148); AI177161 (Nfe212, NF-E2-related factor 2) (SEQ ID NO:94); AF031430 (Stx7, Syntaxin 7) (SEQ ID NO:149); L35921 (Ggamma, GTP-binding protein (gamma subunit)) (SEQ ID NO:100); X62322 (Grn, Granulin) (SEQ ID NO:88); AF028784 (GFAP, glial fibrillary acidic protein) (SEQ ID NO:124); and AI234146 (Csrp1, Cysteine rich protein 1) (SEQ ID NO:141).

Using the method of the invention, we have further identified a set of genes and ESTs that changed with age ($p \leq 0.01$). These include AA891651 (rc_AA891651 EST195454 cDNA) (SEQ ID NO:173); AI070108 (rc_AI070108 UI-R-Y0-lu-a-09-0-UI.s1 cDNA) (SEQ ID NO:170); AI176689 (mitogen-activated protein kinase kinase 6) (SEQ ID NO:19); AI012051 (rc_AI012051 EST206502 cDNA) (SEQ ID NO:191); AI233365 (rc_AI233365 EST230053 cDNA) (SEQ ID NO:157); AA892532 (rc_AA892532 EST196335 cDNA) (SEQ ID NO:154); AA893185 (rc_AA893185 EST196988 cDNA) (SEQ ID NO:399); AA964320 (rc_AA964320 UI-R-C0-gu-e-09-0-UI.s1 cDNA) (SEQ ID NO:177); AA963449 (rc_AA963449 UI-R-E1-gj-e-08-0-UI.s1 cDNA) (SEQ ID NO:153); AA859632 (rc_AA859632 UI-R-E0-bs-h-08-0-UI.s1 cDNA) (SEQ ID NO:172); AI169265 (Atp6s1) (SEQ ID NO:219); AA850781 (rc_AA850781 EST193549 cDNA) (SEQ ID NO:181); AJ222813 (interleukin 18) (SEQ ID NO:78); D38380 (Transferrin) (SEQ ID NO:127); J03481 (dihydropteridine reductase) (SEQ ID NO:115); M24542 (Rieske iron-sulfur protein) (SEQ ID NO:40); L03294 (Lipoprotein lipase) (SEQ ID NO:37); L19998 (sulfotransferase family 1A, phenol-preferring, member 1) (SEQ ID NO:321); U53922 (DnaJ-like protein (RDJ1)) (SEQ ID NO:65); X54793 (liver heat shock protein (hsp60)) (SEQ ID NO:62); X62952 (vimentin) (SEQ ID NO:119); M55534 (Crystallin, alpha polypeptide 2) (SEQ ID NO:105); J03752 (microsomal glutathione S-transferase 1) (SEQ ID NO:71); X64401 (Cytochrome P450, subfamily 111A, polypeptide 3) (SEQ ID NO:42); X78848 (Gsta1) (SEQ ID NO:84); AF016387 (retinoid X receptor gamma) (SEQ ID NO:12); AF031430 (syntaxin 7) (SEQ ID NO:149); AF051561 (solute carrier family 12, member 2) (SEQ ID NO:322); AF076183 (cytosolic sorting protein PACS-1a (PACS-1)) (SEQ ID NO:231); AF095576 (adaptor protein with pleckstrin homology and src homology 2 domains) (SEQ ID NO:18); AF095741 (MG87) (SEQ ID NO:151); AF097593 (cadherin 2, type 1, N-cadherin (neuronal)) (SEQ TD NO:104); AF104362 (osteoadherin) (SEQ ID NO:33); D10699 (ubiquitin carboxy-terminal hydrolase L1) (SEQ ID NO:234); D28111 (myelin-associated oligodendrocytic basic protein) (SEQ ID NO:106); D37951 (MIBP1 (c-myc intron binding protein 1)) (SEQ ID NO:230); D84477 (RhoA) (SEQ ID NO:97); L13202 (RATHFH2 HNF-3/forkhead homolog-2 (HFH-2)) (SEQ ID NO:220); L26292 (Kruppel-like factor 4 (gut)) (SEQ ID NO:218); L46873 (solute carrier family 15 (oligopeptide transporter), member 1) (SEQ ID NO:47); M13100 (RATLIN3A long interspersed repetitive DNA sequence LINE3 (L1Rn)) (SEQ ID NO:435); M27207 (procollagen, type I, alpha 1) (SEQ ID NO:32); M92433 (Zinc-finger transcription factor NGFI-C (early response gene)) (SEQ ID NO:9); M94918 (Hemoglobin, beta) (SEQ ID NO:125); M94919 (Hemoglobin, beta) (SEQ ID NO:452); S55427 (Peripheral myelin protein) (SEQ ID NO:108); S68245 (carbonic anhydrase 4) (SEQ ID NO:38);

S82649 (Narp=neuronal activity-regulated pentraxin) (SEQ ID NO:3); U10894 (allograft inflammatory factor 1) (SEQ ID NO:453); U26356 (RNSHUNA1S100A1 gene) (SEQ ID NO:95); U75397 (RNKROX2 Krox-24) (SEQ ID NO:454); U75405 (procollagen, type I, alpha 1) (SEQ ID NO:217); U77829 (RNU77829 gas-growth arrest homolog non-translated sequence) (SEQ ID NO:140); U92081 (glycoprotein 38) (SEQ ID NO:87); X06554 (RNMAGSR myelin-associated glycoprotein (S-MAG) C-term) (SEQ ID NO:107); X13167 (Nuclear Factor 1A) (SEQ ID NO:89); X14181 (RRRPL18A ribosomal protein L18a) (SEQ ID NO:135); X56325 (Hemoglobin, alpha 1) (SEQ ID NO:128); X60351 (Crystallin, alpha polypeptide 2) (SEQ ID NO:455); E13541 (chondroitin sulfate proteoglycan 5) (SEQ ID NO:102); M22357 (1B236/myelin-associated glycoprotein (MAG)) (SEQ ID NO:109); M24026 (RT1 class Ib gene) (SEQ ID NO:456); M24324 (MHC class I RT1 (RTS) (u haplotype)) (SEQ ID NO:76); J04488 (Prostaglandin D synthase) (SEQ ID NO:69); M115191 (Tachykinin (substance P, neurokinin A, neuropeptide K, neuropeptide gamma)) (SEQ ID NO:28); M74223 (VGF) (SEQ ID NO:4); U17254 (immediate early gene transcription factor NGFI-B) (SEQ ID NOS:225 & 257); U08259 (Glutamate receptor, ionotropic, N-methyl D-aspartate 2C) (SEQ ID NO:323); U19866 (activity regulated cytoskeletal-associated protein) (SEQ ID NO:7); L40364 (RT1 class Ib gene) (SEQ ID NO:79); U17919 (allograft inflammatory factor 1); U78102 (early growth response 2) (SEQ ID NO:15); U67082 (KRAB-zinc finger protein KZF-1) (SEQ ID NO:90); U77777 (interleukin 18) (SEQ ID NO:319); D78018 (Nuclear Factor IA) (SEQ ID NO:457); U92564 (Olf-1/EBF associated Zn finger protein Roaz) (SEQ ID NO:91); AF008439 (Solute carrier family 11 member 2 (natural resistance-associated macrophage protein 2)) (SEQ ID NO:129); AB003726 (RuvB-like protein 1) (SEQ ID NO:6); M83561 (Glutamate receptor, ionotropic, kainate 1) (SEQ ID NO:101); AI639151 (mixed-tissue library cDNA clone rx02802 3) (SEQ ID NO:438); AI639247 (mixed-tissue library cDNA clone rx03939 3) (SEQ ID NO:160); AI639381 (mixed-tissue library cDNA clone rx01495 3) (SEQ ID NO:196); AI639532 (mixed-tissue library cDNA clone rx010495 3) (SEQ ID NO:189); AA799645 (FXYD domain-containing ion transport regulator 1) (SEQ ID NO:130); AA900516 (Pdi2) (SEQ ID NO:150); AI014169 (Vdup1) (SEQ ID NO:152); AI030089 (Nopp140) (SEQ ID NO:11); AI102299 (Bid3) (SEQ ID NO:320); AA818025 (CD59 antigen) (SEQ ID NO:85); AI170268 (Prostaglandin F receptor) (SEQ ID NO:81); AI171462 (CD24 antigen) (SEQ ID NO:137); AI171966 (ESTs, Highly similar to SPS2 MOUSE SELENIDE, WATER DIKINASE 2 [*M. musculus*]) (SEQ ID NO:437); AI176456 (ESTs, Weakly similar to ABP2_HUMAN ENDOTHELIAL ACTIN-BINDING PROTEIN [*H. sapiens*]) (SEQ ID NO:182); AI177161 (NF-E2-related factor 2) (SEQ ID NO:94); AI179576 (Hemoglobin, beta) (SEQ ID NO:458); AI230712 (Subtilisin-like endoprotease) (SEQ ID NO:147); AI230914 (farnesyltransferase beta subunit) (SEQ ID NO:229); AI231213 (kangai 1 (suppression of tumorigenicity 6), prostate) (SEQ ID NO:80); AI237731 (Lipoprotein lipase) (SEQ ID NO:459); M83745 (Protein convertase subtilisin/kexin, type I) (SEQ ID NO:226); M27905 (ribosomal protein L21) (SEQ ID NO:132); M32016 (Lysosomal-associated membrane protein 2) (SEQ ID NO:142); M11071 (RT1 class 1b gene) (SEQ ID NO:460); M15562 (MHC class II RT1.u-D-alpha chain) (SEQ ID NO:74); M15880 (Neuropeptide Y) (SEQ ID NO:31); L08595 (nuclear receptor subfamily 4, group A, member 2) (SEQ ID NO:10); M18416 (Early growth response 1) (SEQ ID NO:8); L40362 (MHC class I RT1.C-type protein) (SEQ ID NO:72); Z50144 (kynurenine/alpha-aminoadipate aminotransferase) (SEQ ID NO:116); X71127 (complement component 1, q subcomponent, beta polypeptide) (SEQ ID NO:70); U44948 (smooth muscle cell LIM protein (SmLIM)) (SEQ ID NO:16); AA850219 (Annexin A3) (SEQ ID NO:96); X73371 (FCGR2) (SEQ ID NO:83); X57281 (Glycine receptor alpha 2 subunit (glycine receptor, neonatal)) (SEQ ID NO:235); X83231 (pre-alpha-inhibitor) (SEQ ID NO:103); X52477 (Complement component 3) (SEQ ID NO:82); X16554 (phosphoribosyl pyrophosphate synthetase 1) (SEQ ID NO:51); X78605 ((Sprague Dawley) rab4b ras-homologous GTPase) (SEQ ID NO:66); X82445 (nuclear distribution gene C homolog (*Aspergillus*)) (SEQ ID NO:232); X52619 (ribosomal protein L28) (SEQ ID NO:134); X68283 (ribosomal protein L29) (SEQ ID NO:138); XI 3044 (CD74 antigen (invariant polpypeptide of major histocompatibility class II antigen-associated)) (SEQ ID NO:75); X54096 (Lecithin-cholesterol acyltransferase) (SEQ ID NO:110); U31866 (Nclone10) (SEQ ID NO:126); U72620 (Lot1) (SEQ ID NO:224); U66470 (rCGR11) (SEQ ID NO:52); M31018 (RT1 class Ib gene) (SEQ ID NO:461); U90887 (arginase type II) (SEQ ID NO:45); M18467 (Glutamate oxaloacetate transaminase 2, mitochondrial (aspartate aminotransferase 2)) (SEQ ID NO:41); M64780 (Agrin) (SEQ ID NO:1); U87627 (putative monocarboxylate transporter (MCT3)) (SEQ ID NO:49); AF019974 (Chromogranin B, parathyroid secretory protein) (SEQ ID NO:223); L03201 (cathepsin S) (SEQ ID NO:131); AB008538 (HB2) (SEQ ID NO:324); D89340 (dipeptidylpeptidase III) (SEQ ID NO:222); M77694 (fumarylacetoacetate hydrolase) (SEQ ID NO:118); M32062 (Fc-gamma receptor) (SEQ ID NO:77); L21192 (brain abundant, membrane attached signal protein 2) (SEQ ID NO:2); M37584 (H2afz) (SEQ ID NO:53); AA858588 (ESTs, Weakly similar to ODP2 RAT DIHYDROLIPOAMIDE ACETYLTRANSFERASE COMPONENT OF PYRUVATE DEHYDROGENASE COMPLEX [*R. norvegicus*]) (SEQ ID NO:184); AA858617 (rc_AA858617 UI-R-E0-bq-b-06-0-UI.s1 cDNA) (SEQ ID NO:161); AA859562 (rc_AA859562 UI-R-E0-bv-b-03-0-UI.s1 cDNA) (SEQ ID NO:403); AA859626 (rc_AA859626 UI-R-E0-bs-h-02-0-UI.s1 cDNA) (SEQ ID NO:155); AA859690 (rc_AA859690 UI-R-E0-bx-e-11-0-UI.s1 cDNA) (SEQ ID NO:396); AA859777 (rc_AA859777 UI-R-E0-bu-e-10-0-UI.s1 cDNA) (SEQ ID NO:188); AA859975 (LOC64201) (SEQ ID NO:39); AA860030 (UI-R-E0-bz-e-07-0-UI.s2 cDNA) (SEQ ID NO:404); AA866291 (rc_AA866291 UI-R-A0-ac-e-12-0-UI.s3 cDNA) (SEQ ID NO:164); AA866409 (rc_AA866409 UI-R-E0-ch-a-03-0-UI.s1 cDNA) (SEQ ID NO:171); AA866411 (NDN) (SEQ ID NO:61); AA874794 (Bex3) (SEQ ID NO:55); AA874887 (rc_AA874887 UI-R-E0-ci-g-10-0-UI.s1 cDNA) (SEQ ID NO:180); AA875004 (rc_AA875004 UI-R-E0-cb-b-07-0-UI.s1 cDNA) (SEQ ID NO:397); AA875037 (rc_AA875037 UI-R-E0-cb-a-03-0-UI.s1 cDNA) (SEQ ID NO:439); AA875047 (TCPZ) (SEQ ID NO:63); AA875059 (rc_AA875059 UI-R-E0-cb-f-04-0-UI.s1 cDNA) (SEQ ID NO:190); AA875129 (rc_AA875129 UI-R-E0-bu-e-01-0-UI.s2 cDNA) (SEQ ID NO:401); H31418 (rc_H31418 EST105434 cDNA) (SEQ ID NO:183); H31665 (rc_H31665 EST105952 cDNA) (SEQ ID NO:158); H32977 (rc_H32977 EST108553 cDNA) (SEQ ID NO:179); H33725 (associated molecule with the SH3 domain of STAM) (SEQ ID NO:228); AA891037 (rc_AA891037 EST194840 cDNA) (SEQ ID NO:398); AA891445 (Skd3) (SEQ ID NO:148); AA891690 (ESTs, Weakly similar to SERC_HUMAN PHOSPHOSERINE AMINOTRANSFERASE [*H. sapiens*]) (SEQ ID NO:440); AA891717 (USF1) (SEQ ID NO:17); AA891734 (rc_AA891734 EST195537 cDNA) (SEQ ID NO:436); AA891785 (rc_AA891785 EST195588 cDNA) (SEQ ID NO:185); AA891810 (ESTs, Highly similar to GTK1 RAT GLUTATHIONE S-TRANSFERASE, MITOCHONDRIAL [*R. norvegicus*]) (SEQ ID NO:86); AA891965 (rc_AA891965 EST195768 cDNA) (SEQ ID NO:175); AA892333 (Tuba1) (SEQ ID NO:120); AA892353 (ESTs, Moderately similar to JC5823 NADH dehydrogenase [*H. sapiens*]) (SEQ ID NO:159); AA892511 (rc_AA892511 EST196314 cDNA) (SEQ ID NO:400); AA892986 (rc_AA892986 EST196789 cDNA) (SEQ ID NO:434); AA893032 (ESTs, Moderately similar to CALX RAT CALNEXIN PRECURSOR [*R. norvegicus*]) (SEQ ID NO:174); AA893082 (rc_AA893082 EST196885 cDNA) (SEQ ID NO:433); AA893493 (RPL26) (SEQ ID NO:133); AA893607 (rc_AA893607 EST197410 cDNA) (SEQ ID NO:195); AA893708 (KIAA0560) (SEQ ID NO:227); AA893743 (rc_AA893743 EST197546 cDNA) (SEQ ID NO:156); AA894104 (rc_AA894104 EST197907 cDNA) (SEQ ID NO:165); AA799449 (EST, Weakly similar to UBP4 MOUSE UBIQUITIN CARBOXYL-TERMINAL HYDROLASE 4 [*M. musculus*]) (SEQ ID NO:187); AA799779 (acyl-CoA:dihydroxyacetonephosphate acyltransferase) (SEQ ID NO:221); AA799803 (ESTs, Weakly similar to KICU RAT KERATIN, TYPE I CYTOSKELETAL 21 [*R. norvegicus*]) (SEQ ID NO:186); AA799854 (rc_AA799854 EST189351 cDNA) (SEQ ID NO:193); AA799996 (rc_AA799996 EST189493 cDNA) (SEQ ID NO:166); AA800693 (rc_AA800693 EST190190 cDNA) (SEQ ID NO:402); AA800708 (ESTs, Weakly similar to S28312 hypothetical protein F02A9.4-*Caenorhabditis elegans [C. elegans]*) (SEQ ID NO:176); AA800794 (HT2A) (SEQ ID NO:13); and AA800948 (Tuba4) (SEQ ID NO:233).

We have also identified age-related ESTs, including AA963449 (UI-R-E1-gj-e-08-O-UI.s1 cDNA) (SEQ ID NO:153); AA892532 (EST196335 cDNA) (SEQ ID NO:154); AA859626 (UI-R-E0-bs-h-02-0-UI.s1 cDNA) (SEQ ID NO:155); AA893743 (EST197546 cDNA) (SEQ ID NO:156); AI233365 (EST230053 cDNA) (SEQ ID NO:157); H31665 (EST105952 cDNA) (SEQ ID NO:158); AA892353 (ESTs, Moderately similar to JC5823 NADH dehydrogenase) (SEQ ID NO:159); AI639247 (mixed-tissue library cDNA clone rx03939 3) (SEQ ID NO:160); AA858617 (UI-R-E0-bq-b-06-0-UI.s1 cDNA) (SEQ ID NO:161); AI639429 (mixed-tissue library cDNA clone rx00973 3) (SEQ ID NO:162); AA858620 (UI-R-E0-bq-b-09-0-UI.s1 cDNA) (SEQ ID NO:163); AA866291 (UI-R-A0-ac-e-12-0-UI.s3 cDNA) (SEQ ID NO:164); AA894104 (EST1197907 cDNA) (SEQ ID NO:165); AA799996 (EST189493 cDNA) (SEQ ID NO:166); AA892805 (EST196608 cDNA) (SEQ ID NO:167); AI639019 (mixed-tissue library cDNA clone rx01107 3) (SEQ ID NO:168); AA799538 (EST189035 cDNA) (SEQ ID NO:169); AI070108 (UI-R-Y0-lu-a-09-0-UI.s1 cDNA) (SEQ ID NO:170); AA866409 (UI-R-E0-ch-a-03-0-UI.s1 cDNA) (SEQ ID NO:171); AA859632 (UI-R-E0-bs-h-08-0-UI.s1 cDNA) (SEQ ID NO:172); AA891651 (EST195454 cDNA) (SEQ ID NO:173); AA893032 (ESTs, Moderately similar to CALX calnexin precursor) (SEQ ID NO:174); AA891965 (EST195768 cDNA) (SEQ ID NO:175); AA800708 (ESTs, Weakly similar to S28312 hypothetical protein F02A9.4) (SEQ ID NO:176); AA964320 (UI-R-C0-gu-e-09-0-UI.s1 cDNA) (SEQ ID NO:177); AA893173 (EST196976 cDNA) (SEQ ID NO:178); H32977 (EST108553 cDNA) (SEQ ID NO:179); AA874887 (UI-R-E0-ci-g-10-0-UI.s1 cDNA) (SEQ ID NO:180); AA850781 (EST1193549 cDNA) (SEQ ID NO:181); AI176456 (ESTS, Weakly similar to endothelial actin-binding protein) (SEQ ID NO:182); H31418 (EST105434 cDNA) (SEQ ID NO:183); AA858588 (ESTs, Weakly similar to ODP2 dihydrolipoamide acetyl transferase) (SEQ ID NO:184); AA891785 (EST195588 cDNA) (SEQ ID NO:185); AA799803 (ESTs, Weakly similar to KICU cytoskeletal keratin (type 1)) (SEQ ID NO:186); AA799449 (EST, Weakly similar to UBP4 ubiquitin carboxyl-terminal hydrolase 4) (SEQ ID NO:187); AA859777 (UI-R-E0-bu-e-10-0-UI.s1 cDNA) (SEQ ID NO:188); AI639532 (mixed-tissue library cDNA clone rx010303) (SEQ ID NO:189); AA875059 (UI-R-E0-cb-f-04-0-UI.s1 cDNA) (SEQ ID NO:190); AI012051 (EST206502 cDNA) (SEQ ID NO:191); AA800549 (EST1190046 cDNA) (SEQ ID NO:192); AA799854 (EST189351 cDNA) (SEQ ID NO:193); and AA892520 (EST196323 cDNA) (SEQ ID NO:194).

Those of skill in the genomics art will understand that the identified genes and ESTs have utility as biomarkers of brain aging. Those of skill in the genomics art will understand that the mammalian homologues (including rat, mouse and human homologues) the identified genes and ESTs are also as biomarkers of brain aging. The easiest method for identifying mammalian homologues of the identified genes and ESTs is by identifying the homologues in the GenBank database, preferably, or in the SwissProtein and the Genome Ontology databases. Additional guidance as to homology can be obtained by using commercially available computer programs, such as DNA Strider and Wisconsin GCG, and following the instructions for the determination of the degree of homolgy between selected polynucleotides.

The foregoing description has been presented only for the purposes of illustration and is not intended to limit the invention to the precise form disclosed, but by the claims appended hereto.

SEQUENCE LISTING (461 sequences)

SEQ ID NO: 1 - DNA, 7286 bp, Rattus norvegicus
tgcttatctcctaccatgaacctggagggctggggagaggacctggtgctcccctagccataactggctaaactttgagatcacagctgcatctgctgctccagagcacccagcatggggggagtagctccgaagaggcctaagggcactccataagaactcccacacacacccaggaattgggctcgagctgtatgtatcatgcctcctctgccactggaacacagacccaggcaggagcctggtgcctccatgctggttcgatacttcatgatcccctgcaacatctgcttgatcctgttggccacttccacattgggctttgcggttctgcttttcctcagcaactacaaacctggaatccacttcacaccagcgcctcctacgcctcctgatgtatgcaggggaatgttatgtggctttggtgctgtgtgtgaacctagtgttgaggatccaggccgtgcctcctgtgtgtgcaagaagaatgcttgccctgctacggtggctcctgtgtgtggctcagatgcctccacctatagcaacgagtgtgagctgcagcgcgcgcagtgcaaccagcaacggcgcatccgcctgcttcgccaagggccatgtgggtcccgggacccctgtgccaacgtgacctgcagtttcggtagtacctgtgtaccttcggctgacggacagactgcctcatgtctgtgtcctacaacctgcttcggggcccctgatggcacagtgtgtggcagtgacggtgttgactaccctagtgaatgccagctgcttagtcatgcctgtgccagccaggagcacatcttcaagaagttcaatggtccttgtgatccctgccagggcagcatgtcagacctgaaccacatttgccgtgtgaacccacgtacacggcacccagaaatgcttctgcggcctgagaactgccctgcccagcacacgcctatctgtggagatgatggggtcacctatgaaaacgactgtgtcatgagccgtataggtgcaacccgtggcctgcttctccagaaagtacgctctggtcaatgccaaactcgagaccagtgcccggagacctgccagtttaactccgtatgcctgtcccgccgtggccgtccccactgttcctgcgatcgtgtcacctgtgatgggtcttacaggcctgtgtgtgcccaagatgggcacacatacaacaatgactgttggcgccaacaggctgagtgtcgacaacagcgggccattcctcccaagcaccagggcccgtgtgaccagaccccgtccccatgccatggagtgcaatgtgcatttggggcagtatgcacagtgaagaacgggaaagccgagtgcgagtgccagcgggtgtgctccggcatctacgatcctgtgtgcggcagtgacggtgtcacttacggcagtgtgtgcgagctggaatccatggcctgtacccttgggcgggaaatccaagtggcccgcagaggaccctgtgacccatgtgggcagtgccgttttggatccctgtgcgaggtggaaactggacgctgtgtgtgcccctctgagtgtgtggagtcagcccagcccgtatgcggttctgatggacacacatacgctagtgaatgtgagctgcatgtccacgcctgtacgcaccagatcagcctatacgtggcctcagctggacactgccagacctgtggagaaaaagtttgtacttttggggctgtgtgctcagctggacagtgtgtatgtccccgttgtgagcaccctccacctggccctgtgtgtggcagtgatggtgtcacctacctcagtgcctgtgagctacgcgaagctgcctgtcagcagcaggtacaaattgaggaggcccatgcagggccatgtgagccggctgagtgtggctcagggggctctggttctggggaggacgacgagtgtgaacaggagctatgccggcagcgtggtggtatctgggacgaggactcagaagatgggccatgtgtctgtgactttagctgccagagtgtccctagaagcccagtgtgtggctcggatggagtcacctatggcaccgagtgtgatctgaagaaggccaggtgcgaatcacagcaagaactgtacgttgctgctcagggagcctgccgtggccctaccttggctccactgctacctgtggccttcccacactgtgcccaaaccccctatggctgctgccaggacaatttcactgctgcccagggtgtgggcttggctggctgtcccagcacctgccattgcaacccccatggctcctacagtggcacttgtgacccagccacagggcagtgctcctgccgaccaggtgtaggaggcctcaggtgtgatcgctgtgaacctggcttctggaacttccgtggcatcgtcaccgatggacatagtggttgcactccctgcagctgcgaccctcggggtgccgtaagggatgactgtgaacagatgactggattgtgttcctgtaggcctggtgtggctggtcccaagtgtggacagtgtccagatggtcaagtcctgggccatctaggctgtgaagcagatcccatgacacctgtgacttgtgtggagatacactgcgagttcggggcctcctgcgtagagaaggctggttttgcccaatgtatctgcccaaccctcacatgtccagaggctaactctaccaaggtctgcggatcagacggtgtgacatatggcaatgaatgccagctgaaggccattgcctgccgccagcgtctggacatctccactcagagtcttggtccctgccaggagagtgttactcctggggcttccccaacatctgcatctatgactaccccaaggcatatcctgagcaagacgctgccatttccccacaacagccttcctctgtctcccggcagtactacccatgattggcccaccccattacccatatcacctcacaccacagtcagcatccccagaagcaccgcgtggcctgtgctgaccgtgccccctacagcagcagcctctgacgtaaccagtctcgcaacatcaatcttcagtgaatccggcagcgccaatgggagtggcgacgaggaactgagtggagatgaggaggccagtgggggcgggtctgggggacttgagcccccggtgggcagcattgtggtgacccatgggccacccatcgagagggcttcctgctacaactcacctttgggctgctgctcagatggcaagacaccctcactggactccgaaggctccaactgtcctgctaccaaggcattccagggcgtgctggagcttgagggggtcgagggacaggaactgttctacacacctgagatggctgaccccaagtcagagttgtttggggagaccgcaaggagcattgaaagcacgctggacgacctgttccggaattcagacgtcaagaaggacttctggagtgtccgcctacgggaactggggcctggcaagttggtccgcgccattgtggacgttcactttgaccctaccacagccttccaggcatcagatgtgggtcaggccttgctccgacagatccaggtatctaggccatgggccctggcagtgaggaggcctctgcaggaacatgtgcgattcttagactttgactggtttcccactttctttacgggagctgcaacaggaactacagctgctatggccacagccagagccaccactgtgagccgactgccggcctcttccgtcaccccacgagtctaccccagtcacaccagccggcctgttggcagaactacagcaccaccaaccactcgccggccaccaaccactgccaccaacatggaccggcctcggaccccaggccatcaacagccctcaaagtcctgtgattcccaaccttgcctccatggaggtacctgccaggaccaggattctggcaagggtttcacctgcagctgtactgcaggcaggggtggctctgtctgtgagaaagtacaacccccctccatgccagcttttaagggccactccttcttggccttccccaccctccgagcctaccacacactgcgcctagcactggaattccgggctttggagacagagggactgctactctacaatggcaatgcacgtggcaaagatttcctggctctggctctgttggatgggcgtgtgcagttcaggtttgacacaggctcagggccagcagtgctaacgagcttagtgccagtggaaccaggacggtggcaccgcctcgagttgtcacggcattggcgtcagggcacactttctgtggatggcgagactcctgttgtaggtgaaagtcccagtggcaccgatggcctcaacttggacacgaacctctatgtgggtggtatcccagaagaacaagttgccatggtgcttgatcggacctctgtgggcgttggcctgaaaggatgcattcgtatgctggatatcaacaatcagcagctggagcttagcgactggcagagggctgcggttcaaagctctggtgtgggagaatgtggagaccatccgtgcttacctaacccctgccatggtggggccctatgccaggcactggaggctggcatgttcctctgtcagtgcccgcctggccgctttggcccaacttgtgcagatgaaaagagcccctgccagccgaacccctgccatggggcagccccctgtcgtgtgctttccagcggtggggccaagtgcgagtgccccctgggacgcagtggtaccttctgtcagacagtcctggagactgctggctcccggcccttcctggctgactttaatggcttctcctacctggaactgaaaggcttgcacaccttcgagagagacctaggggagaagatggcgctggagatggtgttcttggctcgtgggcccagtggcttactcctctacaatgggcagaagacagatggcaagggggactttgtatccctggccctgcataaccggcacctagagttctgctatgaccttggcaagggggctgcagtcatcaggagcaaagagcccatagccctgggaacctgggtcagggtattcctggaacgaaatggccgcaagggtgcccttcaagtgggtgatggtccccgtgtgctaggggaatctccgaaatcccgcaaggttccgcacaccatgctcaacctcaaggagcctctctatattgggggagctcctgacttcagcaagctggccaggggggctgcagtgtcctctggcttcagtggtgtcatccagctggtgtctctaagaggccatcaactgctgactcaggagcatgtgttgcgggcagtagatgtctcaccttttgcagaccacccttgtacccaggccttgggcaacccctgccttaatgggggctcgtgtgtcccgagggaagccacttatgaatgcctgtgtcctgggggcttctctgggctgcactgcgaaaaggggctagttgagaagtcagtgggggacctagaaacactggcctttgatgggcggacctacatcgaatacctcaatgctgtgattgagagtgagaaggcactgcagagcaaccactttgaactgagcttacgcactgaggccactcaggggctggtgctgtggattggcaaggctgcagaacgtgcagattacatggccctggccatcgtggacgggcacctgcaactgagctatgacctaggttcccagccagttgtgctgcgctccactgtgaaggtcaacaccaaccgctggcttcgaatcagggctcacagggagcacagggaaggttcccttcaggtgggcaatgaagcccctgtgactggatcttccccattgggtgccacgcaactggacacagatggagccctgtggcttggaggcctgcagaagcttcctgtggggcaggctctacccaaggcctatggcacaggttttgtgggctgtctgcgggacgtggtagtgggccatcgccagttgcatctgctggaggacgctgtcaccaaaccagagctaagaccctgccccactccctgagctgccaccagagctgccaccttccctactgtaattattttctatttttgtaaacttgttgcatttttatatgatttttttgactgcacgttggccagaaggactgctggcctggcctcctttccgtccggcagctgtgctacagagacaaagtggtgctaagggaactcttaagtagaccgtagcacctagagccctgggctttgaaaggcagccttaggacacactcctctgcctaaggtaccgtgcctcagccccttgcactgtatgttcctacctgtccacttgtattggtcctttgggtctcctggcccattgctaggccctgtttgtgtgttattaatgtgttattggatgagaactgtatccctgagcaggagggtgctgttggggttgagggggcccttcattaaaccaagtaacattgggtcctttgtaggttcccacttaagctgctctcctgtgtgtgctaagggccagcctcaccccaagctagcctggacccctagtgctccctgtgacaatactgtgatataaaaaacctgataattggggcatcatcttacttcccaaaatgtgtttgcctgtccctggaggctgtaaacagaagccaggctccatctaggttgtcctggctggtcctcagttggccttccccacctactcagttaccctgaacatggtcatcctttccccaaaacatcaggccacttaggaatccctaagagggagtgcgtcactacgggatgtggttgacctccattgcttacctgcctaagcagccagctacatctgtctctcaaagatgtccagccagactcctaactatattcttcaaccattgattttgtttgatttctgatgtggaagtgcggtcattcctgttctaacgcacagcaaactttaattggtctaacgtgagggcaacccacagttggtccactgtaacgatggtcatccttgtttgagtgacagttactgccgggtgtccagccaagggcaggtactagaatggcagagatgactatagagccaaaaatgactgaaactgaagcaactgtctgctcctccatcccctatctttaatgtccagcacagtcatctcgggagaaaaaccagacaaatctgggatgggggcagtctgaccttcttcctgcttcggtgatcaaggctagagggaactgcatggtatcttgttactaactccagtatgtgtcaatgtcaaataccatgaaataaagtctgaaaaccttaaaaaaaaa

SEQ ID NO: 2 - DNA, 1208 bp, Rattus norvegicus
gtagtatctaccgagtgatgacctgtcctttactccttgtgtttgctgaaccgcatcctagaataaaggcttttggcctaggaaattatattactggatattaatcatctcatcatcgtaattccttaggcaatgttttggaaagaagtaatgccttgtaccattgaacagatttcagagagcaaaacattcaccatcctctccctcctccatctcgttttctttttcagaagctgtagatgaagccaaacctaaggaaagtgcccgacaggatgagggtaaagaagaccccgaggctgaccaagaacatgcctgaactttaagaaacggctttccacgttgcccccacctgaaccctgtctctcctgccctttctcagatccactctgaagtttcctctcctgtcctgctcacgtgtgtgagcctgtcctctcctacctatgagccctctctctctgtgtggcaaacatttaaaaaaaaaaaagcaggaaagatcccaagtccaacagtgtggcttaaacatttgtttcttggtgttgttatggcgagtttttggtaatgatgatgcagtcatcttgggaaattcttgcactgtaccccggttttttgatctggtgcgtgtggccctgtgggagtccactttcctctctatttctctctgttccaagtgtgtgtgtgcaatgttccgttctgaggagtccaaaatattaagtgaattcaaaaaaccatttctgtttcctcattttcaatgtgatggaatgaacaaaaaggttaaaaaaatttaaaaaaaaaaaccggtttgttttaaaaataaataaataaagcaaatgtgccaattagcgtaacttaaggctgtgaggctcctttttcaatctgaatattaataaatcatgagagtaatcaactttggtgttctgtgttttctttccatatcccttggtctctttgttccgacacatcaggctcttctctttttcctgagctctttcgttagacaactctgggaaaggaagcacagaccctggctaagaccaatggctgccatcccagtgagatagttaggtaccacaatggctggggatgctatgacaaagaacacagtcggtgtggcttaagccaagacatcatctcacggtagtgaaaacgagaggtctgaaatcaggatatcggccttgtggattctttctgaggccaataaaaatatagtg

SEQ ID NO: 3 - DNA, 2562 bp, Rattus rattus
tggtgctggcgtttccctgcttgcacgcggttccctcgagcgccgctccgaccgacgtagccggccgcgaaggcgcccagacggcaagccagcgacccatgctgaagtgagcgcccaggtcagcgagatgctggcgctgctgaccgccggcgtggcgctcgccgtggccgcgggacaagcccaggataacccgatacctggcagtcgcttcgtgtgcaccgcgctgccccccgaagcggcgcgcgccggctgcccgctgcccgcgatgcccatgcagggaggcgcgctgagccctgaggaggagctgcgagccgctgtgctgcactggcgcgagaccgtcgtgcagcagaaggagacgctgggcgctcagcgagaagccatccgagaactcaccagcaagctggcccgctgtgagggactagccggcggtaaggcgcgcggcacgggggccacgggcaaggacaccatgggcgacctgccgcgggacccgggccacgtcgtggagcagcttagccgctcgctgcagaccctcaaggaccgcttggagagcctcgagctccaactccacaccaacgcgtctaatgccgggctgccgagcgacttccgagaggtgctccagcggaggctgggggagctggagaggcagttgctacgcaaggtggccgagctggaagacgagaagtccctgctccacaatgagacctcggctcaccggcagaagacagagaacacactgaatgcactgctgcagagggtgactgagctggagagaggcaacagtgcattcaagtcaccagatgcattcaaagtgtccctccctctccgtacaaactacctatacggcaagatcaagaagacgttgcccgagctgtatgccttcaccatctgcctgtggctgcggtccagcgcctcgccaggcatcggcacgccattctcctacgctgtgcctgggcaagccaatgagattgtgctgatagagtggggtaacaatcccatagagctgcttatcaacgacaaggtcgcacagctgcccctgtttgtcagcgatggcaagtggcaccatatctgcatcacctggaccactcgagacggcatgtgggaagcattccaggacggggagaagctgggcaccggggagaacctggcaccctggcatcccatcaagccagggggtgtgctcatcctggggcaggagcaggacactgtgggaggcagatttgatgccacacaggccttcgttggagagcttagccagttcaacatatgggaccgtgtcctccgggcacaagagatcatcaacatcgccaactgctccacgaacatgcctggaaacatcatcccatgggtggacaacaatgtcgatgtgtttggaggggcttccaagtggcctgtggagacgtgcgaagagcgtctcctggacttgtagctaccttctccctgtcccagaggccaagagcgggctgttctggggagttcaaggcatctattcccgagttcaactaaaatctctggcctgagtaggaaagaaccagagcccctaaggcaggctgtgtggcctcctttgtcttaggctcctatgttcttactgctttgttctttggtgggaagtgaccgaagccctgggaagagtcctgagccacttcctgctggggtttctagtaaagtctgtgagcctctccacccctcctgtaaatgctagtgcaacccagccctgcctgtcattttggatccttagtgtctcgtgtgtgcttcccgtctgtcccctttgatggctgtgtggtcatcctaccggggtggcctgggtcccttgtgtgtgtagcacatccctgcttttgactgaacacagtgcacagaagctacccgcccctgaaacagggtctctccctcagtgtcatgtgcactctggtctctccctctgaggggactgcagctgctggagggccacgtgcccagacagtccccagcatccccaaagcagaccctccgccatggagaaagtcccccacagcttccccaccctctgtccacctctcagaccccacgcttctaaggaccattgctgggttggctttcaaaagctgctgctctcatctggtgccaaaagttcatttgcagcttctacaccgttctgtgtggtttggggattgactttattcccccacaaaagaggaacagccattagaagccagcctcccctccttttgatgctcagcccactgtgaagagtgagcttgcttgtaagccacattggtttctgtgagcatctgactctcccccgtccagtattttccccggaactggagattcgagtgccattcggctgctacctgcttagtgactccaggctgcatcatgtatcataatttattttaaagacaaagtgattcagtggggaaatttataaagctataaatattatatattttatttttcatacatgtttaaagtgcggatccatggatgttccatttgtaggaccagcttgacgtgcccatcctgacattgtatgccacaagagctcttgtgatgatggaattttgattaaagtgcactggaagatga

SEQ ID NO: 4 - DNA, 2507 bp, Rattus norvegicus
gagcgagagcgctgttgctgacccagctgagcccagctcctaggacgccagccctcgaccatctttcatactccagccacggaacggagccagggcagacgggtccggattttccccctgccccgaccctcctctccacctcccgccgtcgtgacaccggctgtctctggcagcccgttggtcatgaaaaccttcacgttgccagcatccgtcctcttctgcttccttctactcatccgggggttgggagcagcaccccccgggcgctccgatgtttatcctcctcccctcggctctgagcataatgggcaggtagctgaggacgcagtgtcccggccaaaggatgacagcgtcccagaggtccgagcggctcggaattccgagcctcaggaccagggagagctcttccagggcgtggatccccgggcgctggccgcggtactgttgcaggcactggaccgtccggcctcgcccccggctgtcccggcaggttcccagcagggaacacccgaagaagcagcagaagctctgctgaccgagtccgtgcgcagtcagacccatagcctcccggcatcagaaatccaagcgtccgctgtggcgccccctcgccctcagactcaggacaacgatcccgaggcagacgaccgctcagaagagctggaggcactagcatccttgctccaagaacttcgagatttcagtccgagtaatgctaagcgccagcaagagacggcggcagcagagactgaaacccgcacgcacacgctgacccgagtcaatctggagagccccgggccagagcgcgtatggcgcgcttcctggggagagttccaggcgcgcgtcccggagcgtgctcctctgccgccctcggtcccttctcaattccaggctcgaatgtccgaaaacgttccccttcccgaaacccatcagttcggggaaggagtgtcctcccctaaaacacatcttggtgagactttgacacccttatccaaggcgtaccaaagtctaagtgcccccttccccaaggtgcgtcggctcgagggctcattcctgggcggttccgaggcaggagagcgcctgcttcaacaagggttagctcaggtagaggcagggaggaggcaggcggaggccacccggcaggccgcagcgcaagaagagcggctggccgatctcgcctccgacctgctgctccagtatttgctgcagggcggcgcccggcagcgcgatctcgggggtcgcgggctgcaggagacgcagcaagagcgggagaacgagagggaggaggaggcggagcaggagagacgcggtggtggggaggacgaggtgggggaagaggatgaggaggcggcagaggcggaggcggaggcagaggaggcggagagggcgcggcagaacgcgctcctgttcgccgaggaggaggacggggaagccggagccgaggacaagcgctcccaggaggaggcgccaggccatcggcggaaggatgctgaggggacagaggagggcggggaggaggatgacgacgacgaagagatggatccgcagacgatcgatagtctcattgaactgtccaccaaactccacctgccagcagacgatgtggtcagcatcatcgaagaggtggaggagaaacggaagcggaagaagaacgcccctcccgagccggtgccaccccccagggctgccccagccccgacccatgtccgctccccgcagcccccacctcccgccccggcccgggatgagttgccggactggaacgaagtactcccaccctgggatcgggaggaggatgaggtgtttcccccggggccctatcaccccttcccaaactacattcggccgcggacactgcagccgcccgcatcctcccgccgccgtcacttccatcacgcgttgccacctgcgcgccaccatcccgatctggaggcccaggccaggcgcgcgcaggaggaagcggacgcggaggagcgccggctgcaggagcaggaggagctggagaattacattgagcacgtgctgctgcaccgcccgtgacccgcccctgcgcgcccgctcccaactgcgcgcgccgccacgcccccctccgtgtcgctcctcctccctctcggtgtttgcatgcgccccggctccgcccctcggctgccgcccggccccgccccacaaggccccgccccgggttctgtcaggaccagacctgtcagacttctttggggtctgatcctggggccagcccaggcgggtgtgtggtttgtgcgagtccccttacacccccacttcctccaggggcctcgtccccatctagtttctctagcgacttcctggtcccaaacggggaaaagctgttctatttaatcgtgtgaagtgtctgtctcccagccttggggcccccggagcctcccttctccaaattgctgtgaacttacccacatcttgcccttctgttgtaaatacccctcacggaggaaatagttttgctaagaaataaaagtgactattttattagg

SEQ ID NO: 5 - DNA, 1697 bp, Rattus norvegicus
tagctggcttgcccgctgccgttgcactgcaccgggccacctctagccggtggatggggatgtctggctgaaccccgggatccgattccctcctccaggacctgctcagggaaacggatcttgacagttgccatcattgtactacggtgccaggatggaggctccactggtgagtctggatgaagagtttgaagatatcaggccctgctgcactgaggacccagaggaaaagccacaaagtctctatggcacatctcctcaccacctggaggacccttccctctccgagcttgagaatttttcttccgaaataatcagcttcaagtccatggaggacctcgtgaatgaatttgatgagaagctcaatgtctgctttcggaactacaatgccaagaccgagaacctggctccagtgaagaaccagttgcagatccaggaggaggaggagactcttcgggatgaggaggtttgggatgctctgacagacaattacatcccttcactctcagaagactggagggacccaaacattgaagctctgaatggcaacagctctgacactgagatccacgagaaggaagaagaagatgagttcattgagaagagtgaaaacgactctggtatcaacgaggagcctctcctcacagctgaccaggtgattgaggagatcgaagaaatgatgcagaactccccagatcctgaggaggaagtggaggtgctggaagaggaggatggaggagaaatctcgtctcaggcagattcagtcctgctacaagagatgcaggccctgacgcagaccttcaacaacaactggtcctatgaagggctgagacacatgtctgggtctgagctgacagagctgctggaccaggtggagggtgccatccgtgacttctcggaggagctggtccaccagctggcccgcagagatgagctggagtttgagaaggaagtgaagaactctttcatcacggtgctcattgaggttcagaataagcagaaggagcagcgggaactgatgaagaagaggcggaaagagaaggggttaagcctgcagagcagtcggatagagaaggggaaccagatgcctctcaagcgtttcagcatggagggcatctccaacatcctgcagagtggcatccgccagacctttggctcctcaggagctgacagacagtacctgaacacagtcatcccttatgagaagaaatcttctcctccctctgtggaagacctgcagatgctgacaaacattctcttcgccatgaaggaggataacgagaaggtgcctactttgctaacggactacattttaaaagtgctctgtccaacctaacctcacctttggagcagcctcactgcaggaggtcactgagcaagaaagtcattccatcactgggattgcatgacaccacgtaacctccggcgtgtatttaaacgtgtatagcttaacctggattaaacatgagcaaccgcgcacgcgcggggtcctttgctgttggcttctagtgctagtaatcattggatgcatgatcgggcgtagggccagtgactctgctccctctaacctgtgttggggaagacaggtgccctcaccactcattatgtagtctggctccagccctcaacccagcttatactcttcagactaattttgaaataaaccttcatttaattaatatcaaaaaaaaaaaaaa

SEQ ID NO: 6 - DNA, 5865 bp, Rattus norvegicus
  misc_feature (1766)..(1766): n is a, c, g, or t
  misc_feature (2325)..(2325): n is a, c, g, or t
  misc_feature (3886)..(3886): n is a, c, g, or t
  misc_feature (4509)..(4509): n is a, c, g, or t
ctcgtgagaacgaatcgatccttcccagccttctctgcctgctctccacctcctctctgctccgagtcttaggagaacgaacattcaaaggacagattccaatgtggtgtgctgtgcacatcgcgagcggctggggtttgcacttcgagatttctttataatttttttttttaatgtaagggagacagtggaattgctacccgtagaatttttattcaagtgcacgtcgcgttgggttgcacgctccacccccagggacctggtgtggtgaaatttgaacccaccgccttagcccaaaggccgagtaacctggctgcttgagtgtcgtggaagacgtgagcgaaatgatcagcgaactcattttttatcagactcgctgaagctggcttttgcgtttttctacacgtacactaattttatggaatagttaaagtgctatattctccgcgcaaccttttcaaattccaaatgtttgaacgttttggtgtcagcgcgagtgaaatcattttaccgacaagaactaactgaattgtctgcctcgttgagttgcctccggaaaagatctcgggggtggaaaagcaactgcaaaataacagacggagaaaattccttggaagttatttctgtagcataagagcagaaacttaagagcaagttttcattgggcaaaatgggggaacaacctatcttcagcactcgagctcatgtcttccagatcgacccaaacacaaagaagaactgggtacccaccagcaagcatgcagttactgtgtcttatttctatgacagcacaaggaatgtgtataggataatcagtctagacggctcaaaggcaataataaatagcaccatcactccaaacatgacatttactaaaacatctcaaaagtttggccaatgggctgatagccgggcaaacactgtttatggactgggattctcctctgagcatcatctctcaaaatttgcagaaaagtttcaggaatttaaagaagctgctcggctggcaaaggagaagtcgcaggagaagatggaactgaccagtaccccttcacaggaatcagcaggaggagatcttcagtctcctttaacaccagaaagtatcaatgggacagatgatgagagaacacccgatgtgacacagaactcagagccaagggctgagccagctcagaatgcattgccattttcacataggtacacattcaattcagcaatcatgattaaatgagatggataaatatgaagttcatttggtttcagaaactcttgagtgaaaaatcccaggtcagacttctttaattaattaattgtttgctgttgctcagattgactgaatatttccattatctgtgtagaaaaaggaacgttaattataggagaaactttttcaatggacaaaacattccattctatctatattttaaagatcccttttgctaaccagttttctgattttctacatgttacgtaagactaataacttgtgattaggatcaatggactcctgctccaaaggaaagccttgccacaggcccacagaggtgccacagaggacggggccaggcaggaacccgtcagcattgaaggttgtttttgtatgccaacaggaggaaagcttgagttgctgctgattcttaaaagaattctgtattctaaaagatacacatcatgttctaaatgcattttaaactagtgacattagttattgggcatactgtggtattactagactacaaagagggatatgaagtggcaccattganagtatttttttaaaagcctgtctaccttaacactaatttttacccttatttaaatgctttttactaaacagttttaggtaaaattaagaaaacagttttgttgactgcacatcttttagaaggaccaacttttagagaattacattctttgacagattaaaaattgcaaagtgagatatttcaaactcttaagtgagttttattgccgttggactgcattaatacggacatacgattaaacttagtagaccaacactgagggatctccttaccaggctgcagaacaaggaaattaagcaataaatgggacttgtgaatggaaggacactctactgctagtgctagtaattctgcataagatggtatacattttgaagaaagctgcttttaattacttttaataatgattttaattactctagtgcaagtgcttcctcgagctataaaggtagctgagcacagcagacctttattccctcagtctgactcctgtactcatattcatttagtgaacatagtcttttaacagaagaccacagttctttgatagcattacaanacttacgttatttaaacgttataaagaacgttattgtaggataaaatgttaaaaactgtatcaaggacaggaagaattcctatctattaagtagtggtttccacctccacttaagactgaactgcactgaacaggtaactgtatacttggtctgacacctagattgaggccatccgcactgaatactgtgacatttaggagtaagaacttttaaatttaacatttaaagaagctacttccagtttatgcacctaaatttgtctaaatgttttccattttgctgaccccattgtattcatactgctccccagagcctagagttgtcctcatcctgacttcctgtccctgagtgtctgagaggagtcactttcactgtaaagacactgcttctgcgccttgtagggaggacttgacagtgctcccatagaaatcctacattatttcaacctcatagttacagtaaaggcaggttataaccagtctttcttattattttaagaatttccagccctagtgttttatgaaagtattcctgtgaatttgatatcttatgatcctatattcatctaattccttaactgaaataaaaatgtccatgtgaggtaggttatttacagcgattgcaggagacatggtgttcttcagagttcccaaaccaggatagtttcaaataggtttttcatggcttctgacgaagaagaccgtaaagttccctgcagtgtgtcagtgatgtgcaagctgaattagtgcaaagtgtcacactgtgaaagcacgtgcttttggcttattatgagaaaacgaaatctttaaattcagtttatgtgtcttaggtccagtttactttgatttgacaactcagttcttctgaccccaccctagtatgtatgtatatgtgtgtgtatgtgtgtgtatgtctgtatgtatatacatacatatacacacacattgtatacatatgctatatatacagtatgtgtatatatatactatatatgaatatatgaatatatatattcaattagttaatagtacatttaagccaaatatccaacataagcacactatgtaagtatctatctggaaagacctatatagaattgagatcaacatttcatgagttagaaacaaaggattttataattaatattacttaagtctaaagtacccatatatttaaattagatatgcaatttttccctcttggcaaagaaagacaaaaatcttgtgtttagagatgatgtagattgtcatttttgcctttccttcctgagtacttgttttaacaacaacaaaaaaagactagtttaagaaaagggattgtccagtatttttctgctttgttaagtctaattttactgttaaacagagagcagaatcactggagtactgggggggttttttgttgtttttttttttttttcttttctgtttttttcggagctggggagcgaacccagggccttgcgctcactaggcaagcgctctaccgctgagctaaatccccaacccctggagtatctgttttaaaagaaagccaggaccgttatgatggccatacccngggtacatagtgaaaacaacagagaccaagcaatgagagtgtgagagtaccaatccaccagtactgctgccggacatggcagctgcctgtgcttttctgaagagtcatagtgtatgctaagtctagaaccattacttagtaaagaggctatgacttttatttgggcctgaaaattttagtggtgtggtcatagtctattctgtatttgtaagctttatttttaaattactgtgttgatttaggaacacaagaaatgtttttatttttaattatgagtgtatataaggttttcagatatgcacagactacaataatagactcccatggagataccacttcagccttaacagtcagggagaaggagcctcactttatcaccgcactcaccctgctctccactgatctgttgttactgcggtgtggaggttcacacgcatgcaggtcttcacacatgatgggtaggcccgcaccaagtgagcctctcccagccttgccgtttcgtttttttattttaatcttacatgtatgggtgttttgcatccaggcatgtcatgcctgtgtccacagaagccagagagggtatcagattccctaaaactggagttctcgatgatcgtgagcgngccattgtgggtgctgggaactgaagctgggtcctctacaagagcagccagcgctcttaaccattgagccactatctgccctgtgttttatttatttatttatttatttatttatttatttatttatttatttattggttctttttttttggactggggaccgaagccagggccttgcacttcctaggcaagcgctctaccactgagctaaatccccaaccccttgttttatttttaaagcaaacgagatacataatttcaaccatgataatttaagattatcttgaactcttaaggaaatgtatatactaagctattatagtttttattttccctaattcagtggcataataccttaccttgagtcgtttactactttctttggtttctaaaaactctactgctaaattacaatgtaaaaacatagggctcgtatatactgtagagtgctgtagatgtcctcgtcatcaactatgcaataacagtctgatcgacacatttcaggagcgatcactctttggtgtgcttctttaaatactttcagaagcttaggatgtgcaaagcaggaagaccgtgggtgtaaatgtttacttatttctttgagagtgttagtaagtcttttctaaattgcttttctcttcaaaattatcgttaacttaaatgataattatctttgaggttaaacagaagctcattgacaaactaaagtgaccttttagggcattctttgagatcatagtcttatatctggggactaaaatgtcattagaccctaatagactaacttgtatgtttgtgtggggaaacgttttcctctctcattcaaggtaactgtttgctgcctgttgttacttgtgtagcattctagaaaatggctaggtttttttataagatttaagacaatagaagtagttttatattattatagttctgttggaatgtgatcctgaaattattactgaaaattagaatttttatttcgctaatgacaaccttgactctcagagatgcagtgtaaattgatacctcatctttccgagagttcagagcacagggcggcagtatgtgaagctgcttttgcactgacgcattttgataagtttggctactgtaatggtaaaaggctcctcaggcactgactgcatttgggttcttccgatgggggatgatccgttctcgtggtgctgctggacttatgcattttggaggtactgcatgtatcttccacactgcttgacattttctctgatctgtgtgtttgcaccaactcattaaaagaaatatgcagaaatatcttctaattcgttgatcttcgctgtatgacagttataatattaaacacttgggttgatccac

SEQ ID NO: 7 - DNA, 3032 bp, Rattus norvegicus
agtgctctggcgagtagtcctccctcagccgcagtctctgggcctcttcagcttgagcggcggcgagcctgccacactcgctaagctcctccggcaccgcgcacttgccactgccactgccgcttcgcgcccgctgcagccgccggctctgaatccttctggcttccgcctcagaggagttcttagcctgtcccgaaccgtaaccccggcgagcagatggagctggaccatatgacgaccggcggcctccacgcctaccctgccccgcggggtgggccggccgccaaacccaatgtgatcctgcagattggtaagtgccgagctgagatgctggagcacgtacggaggacccaccggcatctgttgaccgaagtgtccaagcaggtggagcgagagctgaaagggttgcacaggtcggtgggcaagctggagaacaacttggacggctatgtgcccacgggcgactcacagcgctggaagaagtccatcaaggcctgtctctgccgctgccaggagaccatcgccaacctggagcgctgggtcaagcgtgagatgcacgtgtggagggaggtcttctaccgtctggagaggtgggccgaccgcctggagtccatgggcggcaagtacccagtgggcagcgagccggcccgccacactgtctctgtaggtgtggggggtccagagccctactgccaggaagctgatggctacgactacactgttagcccctatgccatcaccccgccacctgccgcaggagagctgcctgagcaggagtcagttggggctcagcaataccagtcttgggtgccaggtgaggatgggcaaccaagcccaggtctggatacccagatctttgaggacccacgggagttcctgagccacctggaagagtacctgcggcaggtgggtggctctgaagaatattggctgtcccagatccagaaccacatgaatgggccagccaagaagtggtgggagttcaaacagggctcggtgaagaactgggtggagttcaagaaggagtttctgcagtacagtgagggtacgctctcccgcgaagccattcagcgggagctggacctgccacagaagcagggtgagccacttgaccagttcctctggcgtaagcgggacctgtaccagacactgtatgtggacgctgaggaggaggagatcattcagtatgtggtgggcaccctgcagcccaagttcaagcgctttctgcgccacccacttcccaagaccctggagcagctcatccagaggggcatggaagttcaggacggcctggagcaggcagctgagccttctgtcacccctctgcccacagaggatgagactgaggcactcacgcctgctcttaccagcgagtcagtagccagtgacaggacccagcctgaatagaggggccagcccagggtccccagcctgcctgccacacccagtctgtggcttttgtcaactaggacttgattgagctggggctgacacccaaggggatgccctgtccagccagacaccttctcacccactggcctgactcacaactgccacacaaccatgattcatggacatcaagaagcccctctcccatagggctcccacctgccacctacccctcacctgtctgccctagtcctggccctgtctccagtggcctcaccctctacactctcagaccatcacagaacacctttggcttcctcattctgcatcagtgtccagggccctttgggtagtcaagaaatcaagtgtctgaaaggcaatgaaaagtaggcaccaaacccaaggggcatcccagggcagatgctaaagcagaatcagagatggccgaaggaacctctacttccggggatgcagcccgctcctacagacacagcagatccagctggtgccctacctgcctcccagagcaactggccagtcttgggcagcatagctcccctctcagggtgagctgaagcagcagacctgacgcgctggcgcctcctggcccccagcagtgattcataccagtgaagaaaagcagacttcggctccatgactcagccatgccaggcggagggtcccagaggggctgagtcctcagccccagctgaggcagcagctggagtcttcagagccaggtgaatgacaccaggtctcaagctgctgagaagtctttccggccatgtctggaaggggtaccaccccagcaccagcaccgtcccctcctctcttgaagctgcctgcacagaggttccaagacactttcaaggcagagaaaataggattacaaagaggaggtgccttggcagagggcagcacccagctcagcctcagagctgaaggtgaagacaagccagcgtgaaaccccgggtctgccacgaatgcccgctccgctggccactcaccagctgcctgccacaagccactgcagcttgagcagggtctgtgccctctcagcacagagcccagttcgctgcgtggcctttggcccccgccagaaccttgcaggagccttaaggttcgggccctagcccagcctgaccttacctgctgtgccctgcctgctggtcaagtccagtcccaggagaccccatgccttggctcctaggctgttccaggcacttccctgacctgccgggtgattgcccagctggaacctcatccacaccccagcaccaaccacctcgtgttggtaactgctcgtgtctgtagtctgagtaggccatgttgaggttcctccatctgcctggtccattggtgttctgagaccagttccactgctgttctgacagatcccccaccctgtgcccctgccagcccccacaggtttatttttgcacataaaccatgacccatactaatttggctagctctggggactagggagaccctggagatctcaagagtgtggctatcccctattttcaccaagccttcaatatccagccaggccatctggcccacaccatcttacctcaaagacagacatatatatatatatacatatatatgattttgttaataaaactatgaaatttaaa

SEQ ID NO: 8 - DNA, 3112 bp, Rattus norvegicus
cgcagaacttggggagccgccgccgcgattcgccgccgccgccagcttccgccgccgcaagatcggcccctgccccagcctccgcggcagccctgcgtccaccacgggccgcggccaccgccagcctgggggcccacctacactccccgcagtgtgcccctgcaccccgcatgtaacccggccaacatccggcgagtgtgccctcagtagcttcggccccgggctgcgcccaccacccaacatcagctctccagctcgcacgtccgggatggcagcggccaaggccgagatgcaattgatgtctccgctgcagatctctgacccgttcggctcctttcctcactcacccaccatggacaactaccccaaactggaggagatgatgctgctgagcaacggggctccccagttcctcggtgctgccggaaccccagagggcagcggcggcaataacagcagcagcagcagcagcagcagcagcgggggcggtggtgggggcggcagcaacagcggcagcagcgctttcaatcctcaaggggagccgagcgaacaaccctacgagcacctgaccacagagtccttttctgacatcgctctgaataacgagaaggcgctggtggagacaagttatcccagccaaactacccggttgcctcccatcacctatactggccgcttctccctggagcctgcacccaacagtggcaacactttgtggcctgaaccccttttcagcctagtcagtggccttgtgagcatgaccaaccctccaacctcttcatcctcagcgccttctccagctgcttcatcgtcttcctctgcctcccagagcccacccctgagctgtgccgtgccgtccaacgacagcagtcccatttactcagctgcacccacctttcctactcccaacactgacatttttcctgagccccaaagccaggcctttcctggctctgcaggcacagccttgcagtacccgcctcctgcctaccctgccaccaagggtggtttccaggttcccatgatccctgactatctgtttccacaacaacagggagacctgagcctgggcaccccagaccagaagcccttccagggtctggagaaccgtacccagcagccttcgctcactccactatccactatcaaagccttcgccactcagtcgggctcccaggacttaaaggctcttaataacacctaccagtcccaactcatcaaacccagccgcatgcgcaagtaccccaaccggcccagcaagacacccccccatgaacgcccgtatgcttgccctgttgagtcctgcgatcgccgcttttctcgctcggatgagcttacacgccacatccgcatccatacaggccagaagcccttccagtgtcgaatctgcatgcgtaatttcagtcgtagtgaccaccttaccacccacatccgcacccacacaggcgagaagccttttgcctgtgacatttgtgggagaaagtttgccaggagtgatgaacgcaagaggcataccaaaatccacttaagacagaaggacaagaaagcagacaaaagtgtcgtggcctcctcagctgcctcttccctctcttcctacccatccccagtggctacctcctacccatcccccgccaccacctcatttccatccccagtgcccacctcttactcctctccgggctcctctacctacccgtctcctgcacacagtggcttcccatcgccctcggtggccaccacctatgcctccgtcccacctgctttccctgcccaggtcagcaccttccagtctgcaggggtcagcaactccttcagcacctcaacgggtctttcagacatgacagcaaccttttctcctaggacaattgaaatttgctaaagggaatgaaagagagcaaagggaggggagcgcgagagacaataaaggacaggagggaagaaatggcccgcaagaggggctgcctcttaggtcagatggaagatctcagagccaagtccttctagtcagtagaaggcccgttggccaccagccctttcacttagcgtccctgccctccccagtcccggtccttttgacttcagctgcctgaaacagccacgtccaagttcttcacctctatccaaaggacttgatttgcatggtattggataaaccatttcagcatcatctccaccacatgcctggcccttgctcccttcagcactagaacatcaagttggctgaaaaaaaaaatgggtctgggccctcagaaccctgccctgtatctttgtacagcatctgtgccatggattttgttttccttggggtattcttgatgtgaagataatttgcatactctattgtactatttggagttaaattctcactttgggggagggggagcaaagccaagcaaaccaatggtgatcctctattttgtgatgatcctgctgtgacattaggtttgaaacttttttttttttttgaagcagcagtcctaggtattaactggagcatgtgtcagagtgttgttccgttaattttgtaaatactgctcgactgtaactctcacatgtgacaaaatacggtttgtttggttgggttttttgttgtttttgaaaaaaaaattttttttttgcccgtccctttggtttcaaaagtttcacgtcttggtgcctttgtgtgacacaccttgccgatggctggacatgtgcaatcgtgaggggacacgctcacctctagccttaagggggtaggagtgatgtttcaggggaggctttagagcacgatgaggaagagggctgagctgagctttggttctccagaatgtaagaagaaaaatttaaaacaaaaatctgaactctcaaaagtctatttttttaactgaaaatgtagatttatccatgttcgggagttggaatgctgcggttacctactgagtaggcggtgacttttgtatgctatgaacatgaagttcattattttgtggttttattttacttcgtacttgtgtttgcttaaacaaagtgacttgtttggcttataaacacattgaatgcgctttactgcccatgggatatgtggtgtgtatccttcagaaaaattaaaaggaaaataaagaaactaactggt

SEQ ID NO: 9 - DNA, 4011 bp, Rattus norvegicus
ggatccagcatgtcttggctctgtgggcatctacactcgcatgcacatatccacacagagacataaaatttacaataataaaaataaatctaggggttggggatttagctcagcggtagagagcttgcctagcaagcgcaaggccctgggttcggtccccagatccaaaaaaaaagaaccaaaaaaaaaaaaaatcttaaaatgctctttcaggctgccataatggcctttaatcccagaagcatccggtcccctgcaggtggcagaacagggactgccacttctttggaggacaatttgtcagctgtctgtcaaaacttgaatatcctgtagcttagacttacatgtgtgagaatttatcccggatgagttcatattcatagttaagggacagcaacaccaacatttttttaaaaagcagaacgttgtgttcgtaaataggaaccaatccgaggctaattcagggtcttcctgagaactattcagccttagaaagtaacaaactaggtctctgtcttcagacacgatgcaatctttcagctaaagtaaaaagaaaatttccagaacagtttgatgtatggacaaaaatattttcccaaaaactacttaagaaatgtcaacatggctacctcaagaaaaaaaaatgagaaacctttaattttcagaatgtactttcagcttggcatggtgacacccacctttactctcagggctcaggaggcagagacagaggctggtggatctctataagtacagggccatcctggtctacactgtgagttccaggtcatccagaactccatgtgagaccatgtctcaaaaaagaaaggaatgctcttgtatactagttgattccatccacctccattatcaaatctttcattatgacgattttttgtttttccaaagcacagagtaaaatgttaaaacaggaacacacacacacacacacccctaaataaaggtgatctttaaggacctgtttatctcagacccccaatgcaatcacatctagccttttctgtggatggtttcaaactcagatcctcatgcaagtcaatcctgcttgcacctcatgtgctcttaaccacttcagggttcctaagtgtgccggggacttcatgttatctggttatgtctctccttagcaagcgcacaggtgaagaaactggtgttaggtggaaacgaacgttttaaatgggaaacagaggactcgaactagtgattctacggactggagggcgccgcgcatcccgggctctcacatggccctcagcccctgcggggcgcacccgtggcccgacgcgcacgaggctccacgctctggggactcgcgcgcacgtagcggcgcgagcccggcggcggcagcgacgtcacaggccgagctttccttttcgggagtccccggcatacatcctgtgtccatgtttggtcatttacgtcacggcgccagggccggggcctcccgaaatggcagtagcccggggagtcggaagcccggagccagcgccgccgcagctatataagtgggggaactgtaggttgggggagcccggttgcactttggagaaaccaggagccgccgcccgaggcaggtgcgggcgagccagggcgccgcggccccccaaccctcgtccccgagccaagcgccgggagcctggagctggggcgcccggattccctgccagccacgcgcgccccagcccagcgaggccccgggcgccccgccgccaccacgccatgctccacctgagcgacttctccggccccgacgcgctcctctccaagcccaccgaaggctgcgcccacaccagccccgagctgccccggctgcctgctagggacgctccctcggccgccgcgtatcctggaggtaaggagcggggctaggagctcgaagaagccgaatgcgacgaggggtgatgggagaggcgtgcgggggtggggtgggggtccccaagcgcgcggtaccattcccactaaggccacaggcgtctgtgtgggagcccgtgcgtatgcgcgccctggggcgtccgtgggggtcccctgcgctgcaggatccgaagtgcacgaggcgctctgcgggtggcttgcgccaggagggctcgggtcgagggactcgcggctgcaggctccgaggcacgcccttggatgtgtgcggggctgatgcgtggtccctcctttggcaggcgacttcttgagctgggctctgagcacctgcggcgccgggggggacttaacagactcctgcttcctggagggccctgcacccacgcccccttcgggcctcagctacagcggcagcttcttcatccaggcggttcccgaacacccgcacgacccggaggccctcttcaacctcatgtctggcatcttgggcttggcacccttccctagccccgaggcggcagcgtctcggtcccccctggatgtccctttccccgcgggtcccgatgccttgttgccggacctttactccccggatctgagttcggccgccttcccggaggcgttttgggaggccgcgccttcggcgggcgctccctcgcagtgcctgttcgagccccagctctccccgcccgacgtcaagcccgggctgagggcgcctcccgcttcgccagcgctggacgctgctgcttcggccttcaaagggccctacgccccctgggagctgctgtcggccggggctccggggaactgtgggtcgcagggaagcttccagaccaccccggaggcacgcttttccgccgtggggaccaaggtcgaggacctgctgtccatcagctgccccgccgagctgcccggtccggctagcagactctacccgccaggggcctacgatgccttctcgctggccccaggtgacttaggggaggggaccgagggcctcccggcgctgctgacccctccgggcggggagggagggagcggcggcgaaggcggagagttcctggccgtccctcaagcgcagctgtccccgctgggcctgcgcggcgccgccacggcagacttctccaaagccctggtggccgacctcccggggggcagcggagtggcggcgccttcatcccccgccacctccttccccgcggccaaagcccggcgcaagggacgccggggcggcaagtgcagcgcgcgctgcttctgcccgcggccgcacgtcaaggccttcgcctgccccgtggagagctgcgtgcggacgttcgcgcgctccgacgagctcaaccgccacctgcgcatccacacgggccacaagcccttccagtgccgcatctgcctgcgcaacttcagccgcagcgaccacctcaccacgcacgtgcgcacccacaccggcgagaagcccttcgcctgcgacgtgtgcggccgccgcttcgcgcgcagcgacgagaagaagcgacacagcaaggtgcacctcaagcagaaggcgcgcgccgaggagcgcctcaagggcctgggcttctactcgctgggcctctctttcgccgcgctgtagccggagctggctccgtaggtcggcgccgccggccgtcggcgcacgcgacacggtcctgccgctccctcgtccctgctgccttccctgcctcttccacgcacgtccggggccacccgcagcccagctccagttcccccgaagcgcccgccgctcacgcccttcagcacgggctccgcggacagcgcccgctgttttcggagccgccttcctctagccacccgctctggggactgtcctctcggtccacccacagagcaggcgataccttaggactgaagagagtttttgtaactggcgtacgccccacgccttcctctttatcccttcccagagtcaagctggggatgtaccgagccggtctctcaagaactttgtacagcaagtccagcaagcctttggatgtgatgtctttgctttggggttatttcctttttgttgtcgttcattttttgtaaagcagacgctactctcaagcatttgacaaaactgtttatttttgcaattaaaattattgtgct

SEQ ID NO: 10 - DNA, 2559 bp, Rattus norvegicus
tggatccccaaattgctttttaaaaaatatcttggaaactttgtcctttgctgaattacgacactgtccacctttaatttcctcgaaaactccaatcactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaattactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgccccctcagtccgaggagatgatgccacacagcgggtcggtttactacaagccctcttcgcccccgacacccagcaccccgggcttccaggtgcagcatagcccgatgtgggacgatccgggctcccttcacaacttccaccagaactacgtggccactacgcatatgatcgagcagaggaagacacctgtctcccgcctttcactcttctcctttaagcagtccgccccgggcactcctgtgtctagctgccagatgcgctttgacgggcctctgcacgtccccatgaacccggagcccgcgggcagccaccacgtagtggatgggcagaccttcgccgtgcccaatcccattcgcaagccggcatccatgggcttcccgggcctgcagatcggccacgcgtcgcagttgcttgacacgcaggtgcccccgtcgccgtcccggggctctccctccaatgagggtctgtgcgctgtttgcggtgacaacgcggcctgtcagcattacggtgttcgcacttgtgagggctgcaaaggtttctttaagcgcacggtgcaaaaaaacgcgaaatatgtgtgtttagcaaataaaaattgcccagtggataagcgccgccgaaatcgttgtcagtactgtcggtttcagaagtgcctggctgttgggatggttaaagaagtggttcgcacggacagtttaaaaggccggagaggtcgtctaccctcaaaaccgaagagcccacaggatccctctcccccctcacctccgggatctgatcagtgccctcgtcagacccacgtcgactccaatccggcaatgaccagcctggactattccaggttccaggcaaaccctgactatcagatgagtggagatgatactcaacatatccagcagttctacgatctcctgactggctctatggagatcatcagagggtgggcagagaagattcctggctttgctgacctgcccaaagccagtcaggacctgctttttgaatcagctttcttagaattatttgttctacgcttagcatacaggtccaacccagtggagggtaaactcatcttttgcaatggggtggtcctgcacaggttgcaatgcgtgcgtggctttggggaatggattgattccattgttgaattctcctccaacttgcagaatatgaacatcgacatttctgccttctcctgcattgctgccctggctatggtcacagagagacacgggctcaaggaacccaagagagtggaagagctacaaaacaaaattgtaaattgtcttaaagaccatgtgactttcaataatgggggattgaaccgacccaactacctgtccaaactgttggggaagctcccagaacttcgcaccctttgcacacaggggctccagcgcattttctacctgaaattggaagacttggtaccaccaccagcaataattgacaaacttttcctggacaccttacctttctaagactttctcccatgcacgtcaaagaactggaaagaaaaaaaaaatccagagggggctggtcaagatgggtagagagctggctgaagtgtccggttcatgtctcccttctgtagacccctagccctcacccctaaagtaaacaaacaaacaagcaaacaaacaaacacaaattaaaaactgttgctatttcctaacctgcaggcagaacgtgaaagggcattttggctccggggcatcctggatttagaaaacggacaacatacacagtacagtggtataaacttttttattatcagttcaaaatcagtttattgttcagaaggaagattgcaaatgtatgatgggaaatgtttggccatgcttgcttgttgcagttaagacaaatgtaaggcaaatgtaacacacacacacacacacacacacacacacacacacacctcttaatgggaccctcatattttgccctttaacaagacttcaaagttttctgctgtaaagaaagctgtaatatatagtaaaactaaatgttgcgtgggtggcatgaattgaaggcagaggcttgtaaattttatccaatgcagtttggctttttaaattattttgtgcctatttatgaataaatattacaaattctaaaaagtaagtgtgtttgca

SEQ ID NO: 11 - DNA, 508 bp, Rattus norvegicus
tttttttttttttttcagagatgagttccacagattaaagtctttgcctaaggcaatgcacagagtcacatggaggattctgtttatgtgagtgcgcagacccacatttgatcccacccctcaaagccccggtgggccctgacataagtcttgtgatgtttgactgctaagcatgccctgtgctcatcttcatccattgggcctgacaccgaagcttcccgaagccggcgtggatctgccaactttggggataaaattgcagttcttggtacaatttcctactgaactgacaggcaggattctcgatgtgagtgcgatgcaacggtttttgttttgttctcagtagctattagtgctacgtgtttacagtgtgttctagttttaatttcgaagtaagcttttctgacactgagaggcatttgcaacaacttgactcttaccgctgttgtatataagctcatgaatatatttgattcttgttaacatcatcaacatcagcctcgtgccg

SEQ ID NO: 12 - DNA, 669 bp, Rattus norvegicus
ccaagatgaaggacatgcggatggataagtcggagctcgggtgcctgcgcgccattgtgctgttcaatccagatgccaagggtttgtccaacccctcggaggtggagtctcttcgagagaaggtttatgccaccctcgagccctataccaagcagaagtatccggaacagcctggcaggtttgccaagcttctgctgcgcctcccagctctgcgctccattggattgaaatgcctggaacacctcttcttcttcaagctcattggggatacccccattgacaccttcctcatggagatgttggagacccctctgcagatcacctgaaactcctcggcagtagcttcctcacccagagtgacccctgggctggtgtgtgtgtcgccctacccctgcacactgtcctctcccactctgacttcccttcctgtccccaaaatgtgatgcttgtcccgaataactacaacctttctacacatgagacttttctaggtggagttttgtatggttgttaaaggtgacccttctttgctacttaaggggctgagtctggcagttcttggaagagtagccaagcctctgtacatataattatcttggtttaaattattttttcacttgccatggaaagcaaacaaatggaaaagaaaataataaatacgatactggc

SEQ ID NO: 13 - DNA, 644 bp, Rattus rattus
gaagaaagttactagttttattagtttaatgcttcatagaacagaaagaaatctcaaagtcaaacaatatgcactcacttgaagaaaatacagagttagctacctaatggtttgttcttccgtaatgaaaatggatacgtcgaccttcccccgcattgttggtcgaagcccacataatccaattcttccaaaaactcttagcataggtcaatggaaggagtatgaaacattctgagccctaaaaaatatccaggtttgctggatatgttagcaaggcttacctgttcctatctgccttggctatggcataattctaacctagaaactcctttaaaaggcaagtgatttctagactcaagtgttcaacactatccaactagggtcagtcaaaccatcctctcgcacatctgcaagagaagacaatctatgttggcagaaattcccagtcaagaggtcctgcttcccaaagggactttgtgtcaccttagtgacacttaatgatacagtctcacactggtaaaggtgatcaaaggagacaccatgctacagagatataatatcactgacgggttgagcagatcccactggagcatgcacacagaatgcagccagagttaaagccacagatgaagcacactgtaaca

SEQ ID NO: 14 - DNA, 665 bp, Rattus rattus
gaatcagataaggcaaagaatgggaactgttttgaaatttaggacttttagaggtaaccatggtcccctactgttaaaaacaggtatttgtctctcacggttttaagattaagggccagaactatctgcttcacaaatccttgttactctgatttccacatatgatcctaaaggttggacagtggtcccaacagcccgtcaggcccagcttcccgagcctccaactctacttagctgtccatattacgattatcagcttaattctctaagatgtaataaactgacatgcctttgacttctacacactcattaacaagatcattacataacactgcagtgtttcccaagtcaagtgttctttttaatcagatctacaaagcatttactgggatgacatttctgacaaagccacagacttctatcaagcagcatcagtgtagtataaaaagtaagcaaaggaacaaaatagccttcttctttcagcctcatgagcagctgcatttctggggaaggacctacacacatagtaattccttgccaagaaccaggacctctgaaggagggaaatgtggattaatgcattcctttttggtttttaaggagactgtaatagaaatatattaaagatagccttaaatatccaacaatcttctgacttacaactt

SEQ ID NO: 15 - DNA, 2952 bp, Rattus norvegicus
tgctgggcgaggggacacactgactgttataataacactacatcagcaactcctggctccccaacagccggatcccaggcaggagagagtcagtggcagatagccatttttttttcttccttaagaagccaacaacttggttgctagttttatttctgttagaattttttttttgtgtgtgtgtggatgtgtggtggtggtggtcttttctaagtgtggagggcaaaaggagataccatcccaggctcagtccaacccctctccaaaaacggcttctctggcactccaggtagcgagggagttgggtctccaggttgtgcgaggagcaaatgatgaccgccaaggccgtagacaaaatcccagtaactctcagtggttttatgcaccagctgcctgacagcctctacccggtggaagacctcgccgccccgtcggtgaccatcttccccaatggtgaactgggaggcccctttgatcagatgaacggagtggctggagatggcatgatcaacattgacatgaccggagagaagaggcccttggatctcccatatccgagtagcttcgctcccatctctgcgcctagaaaccagaccttcacttacatgggcaaattctccattgaccctcagtaccctggtgccagctgctacccagaaggcatcatcaatattgtgagtgcgggcatcttgcaaggggtcacccctccagcttcaaccacagcctcttccagcgtcacctctgcctcccccaacccactggccacgggacccctgggtgtgtgtaccatgtcccagactcagcctgaactggaccacctctactctccaccaccacctcctcctccttattcgggctgtacaggagacctctaccaggatccttcagcattcttatcgccgccacccaccacttccacctcctctctggcctaccagccacctccttcctacccatcccccaagccggctatggacccaggtctcattcctatgatcccagactatcctggattttttccatctccgtgccagagagatccacatggcgcggctggccctgatcgaaagccgttcccctgccctctggactccctgcgggtcccccctccgctcacgccactctccaccatccgtaattttactcttggggggcccagtgctggcgtcacgggaccaggggcaagtggaggcggtgagggtccccgactgcctggcagtgggtctgcagcagtgactgctaccccctacaatccgcaccacctgcctttaaggcccatcctgagacctcgaaagtaccccaacaggcccagcaagacgccagtgcacgaaaggccgtacccctgcccagcagagggttgcgacaggaggttctcacgctctgatgagctgaccaggcacatccgaatccacaccggtcacaagcccttccagtgtcggatctgcatgcgaaacttcagccgaagtgaccacctcaccactcacatccgcacccacaccggggagaagccctttgcctgtgactattgtggccgtaagtttgcccggagtgacgaaaggaagcgccacaccaagatccaccttcgccagaaggagaggaagagcagtgccccctcgtcatctgcatccgcccagtcttcagcctctggtcctgggggctcgcaggccgggggcagcctgtgcggtaacagcgccattggaggaccactggcctcctgcacctctcggaccaggaccccgtgagatgaagctcccgctgacacaccagtttcttcaggccccagaggccctctatccactcgagctgcaaacactaccgcccttctgtgttcttccccgtgatcccgtgaacctgtgatcctgggcaaaggaccctaatggagcccagctctgtcccaccttctcacagacggccttctgaaaacttaggccattttaaaggagttgactgtcactccaagaaatggggagccagaagagggctgggcgagggcccctggcctacagggctgtgctctaaccctgacagagagatgtttgactatggtctgcgagcccttccctttgaccctcgatgccagttgctctgagactttttctacaataggttgggagttgttgattcctttgagcaaggacagcgaaaaagactaaattaaagcaaaaccgatgtggcactttaatggcttgggacggacttggggtaggggtggggggttgtacagtgagcacagtttagccctggcctggccgctgcactctgtggccctagaacagtgaatggaagtttctcgagccatctcaacccttaagcaatatgtcctataaactcaagagaacgaacggaagtgcaatgtcggggaggacaaagccaatattggctccttttttttgagaaacaaagattattttccagtgtatatccatttagatttttgtgtattttttctttctggatgtgcactgtttctccgagttctgaacctttgggaaaaaagtgtaaaacatttatgatctcttgaatcgagtcaaaagttaacttatttaaaggggggtgtacataggatgcatgcagtggtgttgcaagtgtcctctgtgccttgtgtgatgtgggcagtgttacagggtctgcatgtgtacaggatgccttactatgaaaaaaaaatcactccctgggtttaagtatggctgtatatttctgcctattaatatttggaatttttttagaaagtatatttttgtatgctctgttttgtgacttgaaagtgttaccttcgcagtcaaatttcagatgagagtgtgcttaacgtcactgcagctgacttgtttggttattagctcttaatagttgtggaaagattaaacaatctattctaacacagaaccactaactggagttcagatatcggacggcttatggcaatggtgtaaaataatacttttcaacaataaa

SEQ ID NO: 16 - DNA, 847 bp, Rattus norvegicus
acgagctagacctccctagctccgcccgccgcgtgctcccgcctcccactcggaatgcctgtctggggcggtggaaataagtgcggggcctgcgggagaaccgtgtaccacgctgaagaggtgcagtgtgatgggcggacgttccaccgctgctgctttctgtgcatggtttgcaggaaaaatttagacagcacaacagtggcaattcatgatgaagagatctactgcaaatcatgctacggaaagaagtatggaccaaaaggctatggttatggccagggcgctggcacgctcaacatggaccgtggtgagaggctgggcatcaagccagagagtgctcaacctcacaggcctacaacaaatccaaacacttctaaatttgcccagaaatatggaggtgctgagaagtgctccagatgtggggattctgtgtatgctgctgagaagatcattggagctggaaagccctggcacaaaaactgtttccgatgtgccaagtgtgggaagagtctggagtctacaactctgactgagaaggaaggtgaaatctactgtaaagggtgctacgcaaagaactttgggcccaagggattcggctatggtcaaggagcaggggcccttgttcatgctcagtagtggtgtaaacccagtaagcatggcaaagaacctccattaatgtggatggccttaccgcactcaggctgtgcatcggccagcactcagcactgtgtagcacacacgctatgtgcacaatcgggctggacaggaagcactacactctcctgcccatccgctaacgtttaagaacgttcttttacatttggaataaaattttggtttgatttga

SEQ ID NO: 17 - DNA, 435 bp, Rattus rattus
ggctctaaacaattttatcttaaaaaaaaaaaaagtaaagaaataaaaagaaccacccctggaacagggcgggctctctgtgaacccgccctgcctatagctctccctgactccagggccttctgcagaggcttcggctgctcactgccccctctactcctgggagagcagcccgctagcatccttccccacctcttgagtaagcctgctccccagagtaatcaggtatgtatcttaacttctgcttcagagaaaggaagaaccagtgaagtactcggcccacagaccctctgccaggcactctaagcaagcacgcggcgagcccagatttcgtgtgtccagtgtccaccaaggagacagcacatgcagtgtgccaaaggagcaccagggcccggggactgcgcggtgggggcaggcaaagctggcggtgcgtgt

SEQ ID NO: 18 - DNA, 2856 bp, Rattus norvegicus
ggcacgagcaaagagggagagaacctcaaggggcccgccccgggactgctaagagcgcacgagcctcgcagactgcaggccagggaagcgggagccagcccccgccgccgccgccaccaccggccaccaagggcggagctacggcccggagggccatgcgccaccgggtccgaggatcccggccgcggtccgggcagcgcttctccggcgccccggccggcgcggccgaagctgcgcgcctgtagtccgaggctgccatgggaccaaagccatgaatggtgccacccccggctcggcagccgcccccgccccagtccccgactggaggcaattctgcgagctgcacgctcaggtagctgctgtggacttcgctcacaagttctgccgcttccttcgggacaacccgacctacgacacgcctgacgctgggacctcgttctcccgccactttgcagccaacttcttggcagtcttcagcgaggaagtgcgccgcgtgctggggacagcagctgacaccatggaacccgagcctgcggtgacctccgtgacctcggcgctcaagactgcaacctatggccactctcgcagctccgaagatgtgtctgctcacgtggctaccaaggcccgtgtccgcaaaggcttctcactgcgtaacatgagcctgtgtgtagtggacggagtgcgcgacctatggcaccggcgcgcatccccagagcccgagggtggggccaccccgaaaaccaccgagcctgtgtccgagcctcgtgacaaatggacgcgacgtctgcggctggcacgaaccctggcagccaaagtggagttagtggacatccagcgcgagggcgcactgcgcttcatggtggcagatgatgcagcctccggccctgggggcacggcacagtggcagaaatgtcgcctgctcctccgaagggctgtggccggagagcgcttccgcctggagttcttcgtgccacccaaggcttccagacccaaggtcagcatccccctgtcggccatcatcgaggtccgaaccaccatgcccctggaaatgcctgagaaggacaacacatttgtgctcaaggtggagaacggagcggagtacattctggagacgatagactcactacagaagcactcgtgggtggctgacatccagggctgtgtggatcctggggacagtgaggaagacacagggctgtcttgtgcacggggaggctgtctggccagccgcgtgacctcctgcagctgtgagctcctgacagaagcagacatgccccggcccccagagacgatgacagcagtgggtgctgtggttacagctccacatggccgagctcgtgacaccgtgggagagtccctggctcacgttcccctggagactttcctgcaaaccctggagtcttcaggtggtgtcagtgagagcaataacacaggggatgaaggagctgagctggaccccgatgctgaggctgagctggaactctccgactacccctggttccatgggacactgtcccgggtgaaggccgcccagctggtgttggctggtgggccccggagtcacggcctctttgtgatccgccaaagcgagactcggcctggggagtgtgtgctgaccttcaacttccagggcaaggccaagcaccttcgcctttctctgaatggtcacggccagtgtcatgtccaacacctgtggttccagtcggtgtttgacatgcttcgacacttccacacccaccccattcccctggagtcaggaggatccgctgacatcaccctacgaagctacgtgcgtgcccaaggtccacctcctgatccaggaccagcgcccaacactgcagccccggtcccggcctgctggacggagccggctggccagcactacttctccagcctggccacggccacctgcccacccacttcaccctccaatggcgctggagcatcgtcgtcatccggttcatcatcctctgctacgtccgtgcccccacgcccagccgaggggccactcagtgcgcgcagtcgcagcaacagcacagagcacctgctagaggctgcatccggagccactgaggagcccgcagatgccacgctgggccgcgctcgcgctgtggagaatcagtactccttttactagctgccatgcctattacccacgggtgtcacgcacaacacagcaggccacgaacacctgctgtctgtcctgcccacccacagcctggctagcccatgacggtcaacaacacctaacaaatggctagacacacctatccatggtctagcatggccaagacagatggccagcctagccacttcaaaccccaggggcccattatgaccgtgtgtggcaggccaaggctaagtccatggtcgatcaaacccatgatagccctccaatgatttcacgccccgcccactggtggttggccacgcccaccagcagctatttctatacagtccatcgtatccacgacaggcagctcactgacaactaaccacatttggtgacttcaggccctgcctactgttggttggttactcctacagtggcatcatggccaacccactggctgcctgctttgctcgagggtagcaagccacgtctatcaagcccatgaaggcttacccactgattcctaacaacctcaggccctgcccacccatgttgggtcacatactccaatagcccaccaggctgtggtccgcctagcctaggacagcctgtcacgcccaccagccccagcccaacgctggggggaaaagccaagctcttcagtgaagacaaacattattaaagagcctgttttagggactaaaaaaaaaaaaaaaaaaaaaaaaaaaaaaaaaaaaaaaaaa

SEQ ID NO: 19 - DNA, 603 bp, Rattus rattus
actctttgagccatgaaacaagtgactttcagattttccaacgttgggggaggtggggtgaggagcattaactttgacagttcattcaaaagattcggtgatcacccacggtggagttgacggtcgggagcagccgccatgacagccgcaagccacagtgcataggaagagcccctttgcttgagattttttttttataatattcttaaagatgcatattaaataacttcctctggaccacagacatgattgaacttaaaaaataaaagccctataaacactgccaagtcagccttgtctctgtatctcccttcttgcataaaaatggaatatttccaaccaagcactgaaacataaatattaaaataagtgggatacgctacgaacctactttacaatctcgtcaactactgtagcaccttgttaccagggccaatgcattcattttgtaaagaacacgagagatcccagaggcttgaggactcctcgtatgcctcgccattaaatattttatcaccttttcgagtcctaagcctctatcatatttcatccatatagagagctcaacctacgctagagattccaaggcccccttcggagagg

SEQ ID NO: 20 - DNA, 472 bp, Rattus norvegicus
aatctgtaagcctttactatacaaggctatcatggtacctaggatctgttgtcttctgatatttgtttcatatttgatagggtttgtttgtgccatgatcctcacaggcttaatgtttaggctcaaattttgtaatatcagcatcatcaatcactacatgtgtgacatcttccctgtcattcggatctcctgcagtaacacctatgtcaatgaacttgtgagctctgctgtggtgggtacaggtatcattttatgtagcctccttatcttaatctcttatgctatgatcctttccaatatcctttatatgtcttcaggtaagggttggtccaaagccttgggcacttgtggttctcacatcataactgttagtttcttctatggatctgggctgcttgcttatgtaaagccatcttctgctgagactgtaggccagggaaaaattttttcagtgttttatacatttctggtg

SEQ ID NO: 21 - DNA, 2090 bp, Rattus norvegicus
cccggctgcaagatgcccaagaagaagccgacgcccatccagctgaacccggcccccgatggctccgcggttaacgggaccagctcggccgagaccaacctggaggccttgcagaagaagctggaggagctggagctggacgagcagcagcggaagcgccttgaggcctttctgacgcagaagcagaaggtgggagagttgaaggatgatgactttgagaagatcagtgaactgggggctggcaatggtggagtggtgttcaaggtctcccacaagccatctggcctggttatggctaggaagctaattcacctggagatcaaacccgcaatccggaaccagatcatccgggagctgcaggtgctgcatgagtgcaactccccgtacatagtgggcttctacggggccttctacagtgacggcgagatcagcatctgcatggagcacatggatggtgggtccttggatcaagtgctgaagaaagctggaagaattcctgagcaaattttaggaaaagtcagcatcgctgtgataaaaggcctgacatatctacgagagaagcacaagattatgcacagagatgtcaagccttccaacattctagtgaactcacgtggggagatcaaactctgcgattttggggtcagcgggcagctaattgactccatggccaactccttcgtgggaacaaggtcctacatgtcgcctgagagactccaggggactcactactctgtgcagtcggacatctggagcatggggctctctctggtggagatggcagttggaagataccccattcctcctcctgatgccaaggagctggagctgctgtttggatgccaggtggaaggagacgcggccgaaacgccacccaggccaaggacccctgggaggcccctcagctcatatggaatggatagccgacctcccatggcaatttttgagttgttggattacatcgtcaatgagcctcctccaaaactgcccagtggagtattcagtctggaatttcaggattttgtgaataagtgcttaataaagaaccctgcagagagagcagatctgaagcagctcatggtacatgctttcatcaagagatctgatgccgaggaggtagacttcgcaggctggctctgctccaccattgggcttaaccagcccagcacaccaacccacgctgccagcatctgagcctttgggaagcagcagagaggaatcctctgcccagtggcatgccatgttgctttcaggcctctcccatgcttgtctatgttcagatgtgcatctcatctgtgacaaaggatgaagaacacagcatgtgccaaatcgtacttgtgtcatttttaatattgtctttatcgctatggttactcccctaagtggattggctttgtgcttggggctatttgtctgttcatcaaatacatgccaggttgaactacagtgaaaccctggtgacctgggtggtcttcttactgatgtttgcgctgctgttcatcgtgactcactagctggctgcctgtattgtcaggattctcggacccttggtacttcactcttgctggtgacctctcagtctgaggagagggggccttctgagacccttcacaggcagtgcatgcatgaaaagcatgctttgctgctactgaaatgagcaccagaacgtgtacatcatggtattttatttttgcttttggtatagaactcagcagttcccatttaaaaaaaaaatctaaccagagcccatcactgccatgatagctggggcttcagtctgtctactgtggtgattttagacttctggttgtatttctatatttatttttaaatatactgtgtgggatacttagtggtatatgtctctgagtttggattagtgtttctaaattggtagttattttgaatgtcacaaatggattaaggaatcaacgtatcaagagttctatctttcttccagtctaagtaccaatgctattgtaaacgtgtatagtgcctacaaattgtatgaaaacccttttaaccactttactcaagatgtttatcaaatctaatctcttattctaataaaaatactatcaagttaaagt

SEQ ID NO: 22 - DNA, 576 bp, Rattus norvegicus
tttttttttttttttttcagagttggaagtggttcctttatggaaaaactgaaaatataataaaaattaaaataaaaccagttaaaaaagccagcccctggagtttccacctcctgcctctggccctccagaggggtgaggccctggccccagggcagcaaagggtgagggctttcctgcccttcctcttcccccattccatccccgacttttatctccacagtgggggccccccgagaggaaccaaacctgggtatgggagcaggacccaaggccctgtatcccagggagggaggcttggcatgtgtgcccagccccaaagctccgggcctgtagtgtgggcatgggcagggctgctccctgcctgggcccatctggggttggggaggttagttccagatcttgaggaaggagtcccaggagcctgtatccacagccatcccatcatctgtgaccccaaggcagctcacacggttatcatggccagcgaggacacctgcacggtcacccttcatggcatcccagatgttgcagttgaagtcgtcatagccagcgagcagcatccggccgctgcgt

SEQ ID NO: 23 - DNA, 1517 bp, Rattus norvegicus
cctgatctagacaatccctcactgggactctttccccactgattctagatcgtcagttgacaattaaaagtaatcattacaggacaagcaaaagactcaacttcggaactctcggaagctctgcgacaccagcatctacatctacttctgccagtggttttggaacaggactctttggatctaagcctggcactggattcactctaggaggaacaagtgcaggaacaacagctactacatctgcatctacaacaggctttagtttaggattcagtaaacctgcagcatctgccacaccatttgccctgcccgtcacttctaccacagctagtggtcttactctctcgtctgctctgacatcagctccagcagcatccacaggatttacgttgaataacttgggagcaacaccagccacaactacagcagcatcaacaggactttccttagggggggccttagctggtttgggaggttcacttttccagagtggaaacacagcaacatcaggtctcggacagaatgctttaagcttgtctctggggactgcaacacctacttcagcagccagcagtgaaggccttggtggtatagattttagtacctcatcagataaaaagagtgataaaacgggaacaaggccagaggatagcaaagccctgaaagatgaaaaccttcctcctgtcatctgtcaggatgttgagaatctccagaaatttgtcaaggaacaaaaacaagtccaagaagaaattagtcgaatgtcttccaaagcaatgcttaaagtccaggaggacatcaaggccctgaagcagctcctgtcattggctgctagtgggttgcagaggaacacactcaatattgacaaactgaagttagaaactgctcaggagttaaagaatgcggaaatagctttaagaacccagaaaacaccacctggactccaacatgaaaatacagcctctcctgatgatgagagactccaggttcatcaatttgaggtacagcttcagcagtacaggcagcagattgaagaactagaaaaccatcttgccactcaagcaaacaattcacatataactccgcaagacttatcaatggctatgcagaaaatttatcaaacatttgtagctttagctgcacaacttcagtccattcatgaaaatgtcaaggtgcttaaagaacagtatctcagctacagaaaaatgtttttgggtgatgctggggatgtgtttgaagccaggagaacagaagccaagaagtggcagaatgcacccagagttactactggacccacgcctttcagcaccatgccaaacgcagcagccgttgccatggctgcaacacttacacagcagcaacagcctgctacaggtgatgggtggtgaaatgtagctgagctgaagactagaactcaataatcacttttgtgaacaagttggaattgtcatgttactgtgtaattggtttgcttttaagatgaacaataaattaaataaaataaaaaaaaaaaaaaaaaa

SEQ ID NO: 24 - DNA, 2683 bp, Rattus norvegicus
gaattcgggcgggcgacgagcgaggaccgggcggggcggcggcggcgccgaggccgacaagccgcgcgggccgggccgggccgagcgagcgggagcggagcggagcctcgggcggcgggaggaacagcgccgccgccgccaagatggccgacctggaggcggtactggccgatgtgagctacctgatggccatggagaagagcaaggccacgccggccgcgcgcgccagcaagaagatcctgctgccagagcccagcatccgcagcgtcatgcagaagtatctagaggatcgaggagaagtgacctttgaaaagatcttctcacagaagttaggatacctgcttttccgggacttctacctgaaccatctggaagaggccaagcccttggtggagttctatgaagagatcgagaaatatgagaagctggagacggaggaggaacgtgtggtccgcagccgggagatctttgactcctacatcatgaaagaactgctggcctgctcacatcccttttcaaagaatgccacggagcatgtccagggccacctggtgaagaagcaggtacctccagatctcttccagccatacattgaggagatttgtcagaacctccgaggggatgtgttccacaaattcattgagagtgacaagttcacacggttctgccagtggaagaatgtagagctcaacatccacctgaccatgaatgacttcagtgtgcatcgaatcatcgggcgtgggggcttcggtgaggtctatgggtgccggaaagcagacacaggcaagatgtacgccatgaagtgtctggacaagaaacgcatcaagatgaagcagggagagaccctggctctgaacgagcggatcatgctttccctcgtcagcactggggactgccccttcatcgtgtgcatgtcatatgcattccacacaccagacaagctcagtttcatcctggatctcatgaacggtggggacctgcactaccacttgtctcagcatggagtcttctctgaagccgacatgcgcttctacgcagctgagatcatcctgggccttgaacacatgcacaatcgctttgtagtctacagggacctaaagccagccaacattctcctggatgagcatggccatgtgagaatctcagacctgggcctagcctgtgacttctccaagaagaagcctcatgccagtgtgggcacacacgggtacatggccccggaagtcctacagaagggcgtggcctatgacagcagtgccgactggttctccctgggctgcatgctcttcaagttgttgcggggacacagccccttccggcagcacaagaccaaagacaagcatgagattgaccgcatgacattgacaatggctgttgagctgcctgactccttctcccctgaactccgatccctgctggaaggtttgctgcagagggatgtcaatcggagactaggctgtctgggccgtggggctcaagagataaaagaaagccccttcttccgttccctggactggcagatggtcttcttacagaagtaccctcctccactgatccccccacgcggggaggtgaatgcagcggacgcctttgacattggctcctttgatgaggaggacacaaaaggaatcaagttactggacagtgaccaggaactgtaccgcaacttccctctcaccatctctgagcggtggcaacaggaggtggcagagactgtctttgataccatcaatgctgagacagaccggctggaggcacggaagaaagccaaaaacaaacagctgggccacgaggaggactacgccctgggtaaggactgcatcatgcatggctacatgtccaagatgggcaaccccttcctgacccagtggcagcggcgatacttctacctgttccccaaccggcttgagtggaggggtgaagacgaggctccgcagagcctcctgaccatggaagagatccagtcggtggaagagacacagatcaaggaacgcaagtgtctcctgcttaagatccgaggtggcaagcagtttgtcctgcagtgtgatagtgaccctgagctggtgcaatggaaaaaagagctgcgcgatgcttaccgtgaggcccagcagctggtgcagcgagtgcccaagatgaagaacaagccacgctcacctgtggtggagctgagcaaggtgccactgattcagcgtggcagtgccaacggcctctgattcacccatctgctgcccgcctgcccacccgccttttataaacctctaatttattttgttgaatttttattatttgttttcgcaaagcggaaaaggttttattttgtaattattgtgatttcctgtggccccagccaggcccagccccagggaggggcctgcttgcctcagctcctgctgccaccaacccagccactgtctagcacccctgccccgcccccaccgcatgcccctagggtccttgctcccagtatcttcctactgggaagaggagcaaccctcagcagccctcttgcccctccatggggtgaagccacagtcggtgggtgtgtcacttcaggctctgtgggctacactcagcctgaggcccagctgggtggcccagcacccctaccctaggaaggtgcaacacagggatactacttgaactttcctatcatagctcccatgccacagagggacccgaattc

SEQ ID NO: 25 - DNA, 5459 bp, Rattus norvegicus
ggccgttctgagcgagcagaagccggagccgagccggggcccgtgccggcgccattgcgcgggrgccgcgggcaaakctcggcgccgggcggcgggccgggccaggccatgcgggccgagtgagctggcgcccgcagcccgcggcgcggcatggcttccccgccgagctccgggcagccccggccgccgccgccgccgccgccgcccgcgcgcctgctgctgcccctgctgctgtcgctgctgctgtggttggcgcccggggcctggggctggacgcggggcgccccccggccgccgcccagcagcccgccgctctccatcatgggcctcatgccgctcaccaaggaggtggccaagggcagcatcgggcgcggcgtgctccccgccgtggagctagccatcgagcagatccgcaacgagtcactcctgcgcccctacttcctggacctgcgactctatgacaccgagtgtgacaatgcaaagggactgaaagccttctatgacgcaataaagtatgggccgaaccatttgatggtgtttggaggcgtctgtccgtctgtcacatctattatcgcggagtccctccaaggctggaatctggtgcagctttccttcgccgccaccacgcctgttcttgcggataagaagaagtacccgtatttcttccggacggtgccgtcagacaacgcggtgaaccccgccatcctgaagctcctgaagcacttccgctggcggcgtgtgggcacactcacgcaggacgygcagcgcttctccgaggtgaggaatgacctgactggggttctgtatggggaagatattgagatctcagacacagagagtttctccaatgatccctgcaccagcgtcaaaaagctcaaggggaatgacgtgcggatcatccttggccagtttgaccagaatatggcagcaaaagtcttctgttgtgccttcgaggagagcatgtttggcagcaagtaccagtggatcatcccgggatggtacgagcctgcgtggtgggagcaggtgcatgtggaggccaattcctcacgctgcctgcgcagaagcctcctggctgccatggaaggttacatcggagtggactttgagcccctgagctccaaacaaatcaagaccatctcagggaagactccacagcagtttgaaagagagtacaacagcaaacgttcaggcgtggggcccagcaagttccatgggtacgcctacgatgggatctgggtcatcgccaagaccctacagagggccatggagacactgcatgccagtagcaggcaccagcggatccaggacttcaactacacagaccacacgctgggcaaaatcatcctcaatgccatgaacgagaccaacttcttcggggtcacgggtcaagttgtgttccggaacggggagagaatgggaaccattaaatttactcaatttcaagacagcagagaggtgaaggtcggcgaatacaacgcggtggctgacacactggagatcatcaatgacaccataaggttccaggggtccgagccacccaaggacaagaccatcattctggagcagcttcggaagatctcgcttccactgtatagcatcctgtccgctctcaccatcctcggcatgatcatggccagcgccttcctcttcttcaacatcaagaaccggaaccaaaagctgattaagatgtcaagcccctacatgaacaacctcatcatcctgggaggaatgctgtcctatgcatccatcttcctctttggcctcgacgggtccttcgtctcagaaaagacctttgaaacactctgcacggtccggacctggattctcaccgtgggctacacaactgcctttggggccatgtttgcaaagacctggagggtccatgccatcttcaaaaatgtgaagatgaagaagaagatcatcaaagaccagaagctgcttgtgattgtggggggcatgctgctcatcgacctgtgcatcctgatctgttggcaggctgtggaccccctgcggaggacagtggagaggtacagcatggagccggacccagcaggccgggacatctccatccgcccattgctggaacactgcgaaaacacccacatgaccatctggcttggcattgtctacgcctacaaggggctcctcatgctattcggttgtttcttggcatgggaaacccgcaatgtgagcatccctgccctcaacgacagcaagtacatcggcatgagtgtgtacaatgtggggatcatgtgcatcatcggggctgctgtctccttcctgacgcgtgaccagcccaacgtgcagttctgcatcgtggccctggtcatcatcttctgcagcaccatcactctctgcctggtgtttgtgccaaagctcatcactctgaggacaaaccctgacgcagccactcagaacaggcggttccagttcacacagaaccagaagaaagaagattcgaagacctccacttcagtcaccagcgtgaaccaggcgagcacgtcacgcctggagggactgcagtcagaaaaccaccgccttcgaatgaagatcacagagctggacaaagacttggaagaagtcaccatgcagctacaagacacaccagagaagaccacatacatcaaacagaatcactaccaagagctcaacgacatcctcagcttgggcaacttcacagagagcacagatggaggaaaggccattctaaaaaatcacctcgatcaaaacccccagctccagtggaacacgacagagccctcaagaacatgcaaagaccccatagaagacatcaactccccggagcacatccagcgccggctgtcgctccagctccccatccttcaccacgcctacctcccatccatcggaggcgtggatgccagctgcgtcagcccctgtgtcagccctaccgccagccctcgccacagacacgtaccaccctccttccgagtcatggtctcgggcctgtaggggtgggaggcctggggccggggcctccccgggacagcaccatgctgggccaaggcgcctgccacaggcacactgacggcggcgagaagctgggcaccatgctgcctctccagactgctggaatggcgctcaggcagagcgggactcggcaccgacctcgagccttatctgtgaaggtcttactctcacagaggagaggaatgacaatgacttctccttcttggcgtctgcaaacaaagaggagttgggatgtctgaaacttgcaawaacaaatcaaactctagacaaaggagagaggcctcggactcctgctgtcctcgccaagtggccagagcaagggctctgcagaaatggccctcggcactctgcacacacgtcatcggtggtgcccgcccccacacaccagcccttctccactctgggggagaaggtgagcagggccaccaggtccccagcagctggcccagtccacttcagacttcctggaacaagggagtcagcaggaagggtagccgggctctgccctggggctgggggaatcagagcaagcagctgcgcatgctcccaggggacatccatcagaagagagatgtttgttactctctgataaatgccacacattaacacaataacacccgttccggggactgtggggattcagggcaccgcactgcagacatgctctgcaggatgcaacagacagtctgtcatgcacctaccgtgtcggccatgttcttgtgttcaaatttagggttcccggtaataaggggaaccatctgagctaatcatggaatgtctgctcccagaaaacacgataaagaaagattgtgcactttaacctctcccatgggggcccaagggctgctgggattccccctctcccaacacactgactttgtttttgaccaaagtgaatcaggggcattctgctaaaagtcatctctgtgttcctgagctagagctgctggcccagggccccctggcttccagaaggtagccctccagtgcccctccagccctaacccgtgagtgcccacctagggtgtcacctgaggcggtcartcagcaggctggttcccatccatcacgacatactttccttgtaattgaaccccaaagagcactggcctgggagtcagacctggatttgagtcctcagtcccttcagactctctccgtgaccttgggcaagtcaccagtgtctctctgagcctcggtttcccctctgtaacagactggggttgaaataacacccatcctgcctacctcacagggtcactctgaggatggacacttgatctcattcatccaggagagctttgcactgggaagcagctctgacctgtgaggtattagtacgaccatgaccttcagccctcccaccagctggggagggtgcggtgcggcccagagaaacttcctgcaaggccctctacctagggacaggaacagcccagtcagaggcaggctcaggactcttctgacattccttaataggttcattctttgctaaaggcctgaatggcaccrtccaggggcgtctgcacaaacgagtggtttgctcactccctaaagaatcctaaaggcagcttcaacaggcaggcaataatctcttcccagaccactgcagtcaggaacacactgctgtcaaccaccaggctgtgacgaaagggcccacgggaatcaccatcgccaacatttcaaaacaccctagttcacgtagcatagctcttcctccccatccctcaaagagaggttacagaggttctgtagcttttaaggggggaaaaatgtcaacacatcacaggtcaagttgatgtccttctctgtttaggcaccaaaactccgtgttgtcactcactgtgtgtgttaaccagtatttccttgctttttcgacttcaccaaaaccaaatttcatttaaaagaccgyattagtttttttcaaagggaaagagataattaactgtacataatgtatacagacaaaacaaaacctgtagaaatattactccagcatagcaggaaaaaaaaaaaaacaaaaaacaaaaaacaaaagtattggattgtcggaggtgagcgtgcgtctgtaatcccttgtgactccgaactgtgctccgtcttctaggttaacccacaagatacatctctgtctactgatcctgtaggttcacccatttttttttaatttctctgcaattaacaagccccacaaagtgattctggctatctactggttctgttcttttatatgcagcaaacacacggtccatttcctagaggcttccgcccaagggcatcttccagtgacgctagtgcgcacacacacacacacacacacacacacacacacacacacacacacacgactgctttcaattagaccggaactggcagaatcaaatgtaaatgaggagtttctctcgccccactgcatggtatcgatttttaataaattgttgcaaatttgtttttatgaataacagggg

SEQ ID NO: 26 - DNA, 417 bp, Rattus rattus
aagatgggattacaactttaatctgatcaacgtgaagaaggtagggaagacattaaagaaatctattttaggtctgttttatacacagccagatgcaattttcctaaaaagtacaccaaagttttaaaaaccacattttgtcagaatccctcaggaaaccacactatgtgtaatccaggaaagacactatttgcagaatgggaaaatcataatgggcgaggggattaaaacaaaggaaagcacgggcggggtgggagggggggttcaagcagttctaggggagtttgcctgcagaaatgtcaaagctcctgggtggcgggtggccatggaaacatgctaatgaggggctggtcccagtcttagcatggctttctttggagaagtggcggagtcggaggtcatggcagctgtctcaga

SEQ ID NO: 27 - DNA, 782 bp, Rattus norvegicus
ctcccccaccccaattacagcccagatgaaaattagctgcgacaatgctgtggtgaggatggtctccagtggaaaacacatgaaccgtgtgacttttgagtatcgtcagctggaaccactcgagctggaaacctcgaccagaaacagcatcccggagtactgcttgtctagtctttgaatgaccagcttcagtgactggcatgccgttagcccagtgagttctccacagttattttggacggagtgaaaagccttccagtcagtattccaggctttgaaaacctgcacacatgacttccaatttcgcttccttttgttataatgtatcaacgagcagaaggcagataacaggtgcctgttggaaatgcttggccattttggtgtgctgcagacaagaactggtgaaacaagggtccagcaagtgaggaagagagctgtgtggcaagggcaggtgctccaaagagaaagaaatggcagcactcaccgtttcatggcataataataataataataataataataataataataataataataataataaaagttttgagtataccaaaggaattgtatcttatttttacttcatacttctgtttacaaattgtagctatccgttattaattggtagtacttgttttttaaacaacactttgtagcatgggaacaaaacctcctttctattcataaatccaaatgcaaataaatgtatgcagaatgttggcatcttgactgtctgatgtattggctttcctgagtggtccctgccttcattacct

SEQ ID NO: 28 - DNA, 1035 bp, Rattus norvegicus
tcgaccagctccactccagcaccgcggcggaggagagcgaggacgcccaggcaagtgcgcacctgcggagcatcaccgggtccgaccgcaaaatccaacatgaaaatcctcgtggcggtggcggtcttttttctcgtttccactcaactgtttgcagaggaaatcggtgccaacgatgatctaaattattggtccgactggtccgacagtgaccaaatcaaggaggcaatgcccgagccctttgagcatcttcttcagagaatcgcccgaagacccaagcctcagcagttctttggattaatgggcaaacgggatgctgattcctcaattgaaaaacaagtggccctgttaaaggctctttatgggcatggtcagatctctcacaaaaggcataaaacagattcctttgttggactaatgggcaaaagagctttaaattctgtggcttatgaaagaagcgcaatgcagaactacgaaagaaggcgtaaataaaccctgtaacgcactatctattcatctccatctgtgtccgcgagcagtgagcggtaaaataaaaatgtgcgctatgaggaatgattatttatttaatatcaaatgttgttatgagtgaaaaactcaaaaaagtgtttattttttcatattgtgccaataagcattgtaattctaatgtggtgacctcctcagacagaagtagaaattagttgtaacttcagcaaagcacagtgttgatggagttgtacaagtttgccagcgatgcaagtctccaaagacagaaaggctgctgtgaggcagtgcaggcggctgctgctggaggcagagaaactcctgtgtgtcttgcgcttcccttggttgcttttatcctaatgatgtactgagagtttggtatctgactctatttgtatcctagcagcatgtttcctgtgttgtgactatatagagatgtttttaaaagtttcaatgtacttctctggtcttcagtcattgtatgatgtgttgtgatagctaccattttaaataaaagaatgtatcttcagg

SEQ ID NO: 29 - DNA, 669 bp, Rattus norvegicus
  misc_feature (648)..(648): n is a, c, g, or t
ggcaacatgtctctcctggagattggctatactttttctgtcatacccaagatgctgcagagccttgtgagtgaggcccgagggatctctcgggagggatgtgccacacagatgtttttcttcacactttttggtataagtgagtgctgcctattggcggccatggcctttgaccgctgtatagccatatgctccccactccactatgcaacccgaatgagtcgtggggtatgtgcccatttggcaattgtttcatggggaacaggttgcattgtggggttgggacaaaccaattttattttctccttaaacttttgtgggccctgtgagatagaccacttcttctgtgaccctttccaacttttcctgggcacttgcctgtgggagatacatcccaaaacggaggctgccatctttgtggtagcaatcctctgtatatctagtccgtttttactgatcatttattcttatgtcagaattctggtcgcagtgctcgtgatgccttcacctgaggggcgccataaagctttttccacctgttcgtcccacctacttgtagtcacactcttctatggctcaggatccattaactacttgaggcccaaatctagccattcaccaggaattgatagactcttggctctcttntacacagcagtgacatccatg

SEQ ID NO: 30 - DNA, 1002 bp, Rattus norvegicus
atggactcaagcaacaggacaagagtttcagaatttcttcttcttggatttgtagaaaacaaagacctacaaccccttatttatggtctttttctctctatgtacctggttactgtcattggaaacatatccattattgtggctatcatttcagatccctgtctgcacacccccatgtatttcttcctctctaacctgtcctttgtggacatctgtttcatttcaaccactgttccaaagatgttagtgaacatccagacccaaaacaatgtcatcacctatgcaggatgcattacccagatatactttttcttgctctttgtagaattggacaacttcttgctgactatcatggcctatgaccgttacgtagccatctgtcaccccatgcactacacagttatcatgaactacaagctctgtggatttctggttctggtatcttggattgtaagtgttctgcatgccttgtttcaaagcttgatgatgttggcgctgcccttctgcacacatctggaaatcccacactacttctgtgaacctaatcaggtgattcaactcacctgttctgatgcatttcttaatgatcttgtgatatattttacacttgtgctgctggctactgttcctcttgctggcatcttctattcttacttcaagatagtgtcctccatatgtgctatatcgtcagttcatgggaagtacaaagcattctccacctgtgcatctcacctttcagtcgtgtctttattttactgcacaggactaggagtgtacctcagttctgctgcaaacaacagctcacaggcaagtgccacagcctcagtcatgtacactgtagttacccctatggtgaacccttttatctatagtcttaggaataaagatgttaagagtgttctgaaaaaaactctttgtgaggaagttataaggagtccaccttccctacttcatttcttcctagtgttatgtcatctcccttgttttattttttgttattaa

SEQ ID NO: 31 - DNA, 539 bp, Rattus norvegicus
caagctcattcctcgcagaggcgcccagagcagagcacccgctgcgcagagaccacagcccgcccgccatgatgctaggtaacaaacgaatggggctgtgtggactgaccctcgctctatccctgctcgtgtgtttgggcattctggctgaggggtacccctccaagccggacaatccgggcgaggacgcgccagcagaggacatggccagatactactccgctctgcgacactacatcaatctcatcaccagacagagatatggcaagagatccagccctgagacactgatttcagatctcttaatgagagaaagcacagaaaatgcccccagaacaaggcttgaagacccttccatgtggtgatgggaaatgaaacttgctctcctgacttttcctagtttccccccacatctcatctcatcctgtgaaaccagtctgcctgtcccacccaatgcatgccaccaccaggctggattccgacccatttcccttgttgtcgttgtatatatgtgtgtttaaataaagtatcatgcattc

SEQ ID NO: 32 - DNA, 147 bp, Rattus norvegicus
tcaatttccccaaaagccaaaaattgggagacaattttacatggactttggaaaacatttttttcctttgcattcatctctcaaacttagtttttatctttgaccaactgaacgtgaccaaaaaccaaaagtgcattcaaccttacc

SEQ ID NO: 33 - DNA, 1536 bp, Rattus norvegicus
ttgaaactgaagcaatctcaacaggagaagaaatgggctgtttacgtccaatatatgtcctcttcttctgttttgtagttagagtatacggccaatatgaagcttaccagtgggatgaagattatgagcaagagccaagtgaggattatgagccagaattccagtttcaccaaaatatcgaatatggagctcccttttatcagaatattttaggttgtgctaaggaatgcttctgtccaactaactttccaacatcaatgtactgtgacaaccgcaaactcaagactatcccagatattccaatgcacattcagcaactcaaccttcagttcaatgatattgaggctgtgactgcagattcattcatcaatgcaactcatcttaaagaaattaaccttagccacaacaaaattaaatctcaaaagattgattatggtgtgtttgctaaactttcaaatctacagcaacttcatctagatcacaataacttagaagaatttccatttcctcttcctaaatctctggaaagactccttcttggttataatgaaatctctacacttccaacacatgccatggatgggctggtaaatgtcactatgcttgacctctgctataaccatctctctgactccacgttaaaaggaaagattctttccaaactggaaaagctcatgcagcttaacctgtgcaataacaggttagagtcaatgccccctgggttgccgttatcacttatgtatctatctttagaaaataattcaatttcatctataccagaggattactttcagaaacttccaaaacttcatgctctaagaatatcacacaacaaacttgaagacattccatatgacatctttaatctttccaatcttatagaactcaatgttggacataacaaactgaagcaagcattctacattccaaggaatttggaacatctatacctacaaaataatgaaatacaaagcatcaatgtgacaatgatgtgtccttctcttgatccattacaccatcaccatttaacataccttcgtgtggaccaaaataagctgaaggaaccaataagttcatatatcttcttctgcttccctcggatacacagtatttattatggtgagcagaggagcactaatggtgaaacaatacaactgaagacccaagttttcaggcgctatcaagatgaggaagaggaagaggaagacgacagtcaggaccacactcttgagggtcaagaagaaacagaagagcactttaattctcattactatgaaatgcaagcatggcaaaatactatataggtacatatttatgactccataaagccttaataattacaaatgtaagcgtatacctgctcataataatatatctagaagtatgtgctagtataaagacccgaattgcatttgagatgttagtgagaatggttttacttcataggcgtagtgcttactagaaacgatgcaaaccttaagaaatataaagtagaatggcaagtgggaataaacaaaactaagctcaaaaaaaaaa

SEQ ID NO: 34 - DNA, 3519 bp, Rattus rattus
ctggaggggagcagagaggagggaaggagcagcggaggcagtgagctgggagcggctgaggcccttcccgcagaaactgggggcaccggcggcgtaggaggtggagaaggcggaggacgcacgggctggaggcggcggctgcgactcggcggcgctgggaatcggaaccgcgggtgaacttgggcgccacgttccgggcgacggccgggtgaggatggtgaacacttgcagccgctgaccctgcctttcctctgtttcctcgcgggttgccgagcctggcgcccatccccacccctggacgggtgggtgaacctgcaagcttctacccaccccaggactattttttcttttaaaaggaaacagggagtgggcattcggaaagagggagaaaacgcaggggagctcgtccatccgttgaggcagagttcactatgatcttactcgcattcagctctggaagaaggttggatttcgtgcatcgttcgggggtgtttttcttccaaaccttgctttggattttatgtgctacagtctgcggaacggagcagtatttcaatgtggaggtttggttacagaaatacggctaccttccaccgactgaccccagaatgtctgtgctgcgctctgcagagaccatgcagtcagccttagctgccatgcagcagttctatggcattaacatgacaggaaaagtggacagaaacacaattgactggatgaagaagcctcgatgtggtgtaccagaccaaacaagaggcagctctaaattcaacatccgacgaaagcgctatgcattaactgggcagaagtggcaacacaagcatatcacttacagtataaagaacgtaactcccaaggttggagatcctgagacccggagagcaattcgccgtgcctttgatgtgtggcagaatgtaacacctctaacgtttgaagaagttccctacagtgaactagaaaatggcaaacgtgatgtggatataaccatcatttttgcttctggtttccatggagacagatccccctttgatggggagggaggatttttggcccatgcttatttccctgggccaggaattggaggcgatactcattttgattctgatgagccatggacactgggaaatcccaatcatgatggaaatgatttatttcttgtagcagtccatgagctgggacatgctctagggctggagcattccaacgacccaacagctatcatggcaccattttaccagtacatggaaacagacaacttcaagcttcctaatgatgatttgcaaggcatccagaagatatatggtccacctgacaagatccctccacctacaagacctctaccgacagtgccccctcaccgatctgtccctccggccgacccaaggaaaaatgacaggcccaaacctcctcgacctcccactggcagaccttcctatccaggagccaaacccaacatctgtgatgggaacttcaacactctagctattcttcgaagggagatgtttgttttcaaggaccagtggttttggcgagtgagaaacaacagggtgatggatggataccccatgcaaattacttacttctggcggggccttcctcccagtattgatgcagtttatgaaaacagtgatggaaattttgtcttctttaaaggtaacaaatactgggtgttcaaagacacaactcttcaacctggataccctcatgacttgattacccttggaaatggaatcccccctcatggtattgattctgccatatggtgggaagatgttggcaaaacctatttcttcaaaggcgaccggtattggagatatagtgaagaaatgaaaaccatggaccctggctatcccaagcccatcaccatctggaaaggaatccctgaatcacctcagggagctttcgtccacaaggaaaatggctttacctatttctacaaaggaaaggagtattggaaattcaacaaccagatactcaaagtagaacctgggtatccaagatccatcctcaaggactttatgggctgtgatggaccaacagaccgagataaagaaggtctcagcccaccaccatgatgtagacattgtcatcaaactggacaacacagccagcactgtgaaagccatagctattgtcattccctgcatcttggccttatggcctccttgtattggtttacactgtgttccagttcaagcggaaaggaacaccccgccacatactgtactgtaaacgctctatgcaagagtgggtgtgatgtagggatttcttttttctttcttttccggagtttgtggtaacttgagattcaagacaagagctgttatgctgtttcctagctaggagcaggcttgtggcagctgatcgaggctgaccttccaaacctagatggttgctggtcctgcacatgagtggaaatatattcatggagaaacttccatgatgcacagtatctgccgttcttcagtcctctgtctttctttgtcattcagttctaggctttcctctgcacgctcaatgcccagtaaaatttcaggattaactgaagaagaggaaatatagaagaaaagtttcttcttatttttttttaaaatacttttccttctgaaatctgagcccatttctgggaaagagaaagaaagagagagagagagagagagagagagagagagagagagagagagagagagaaagcaaatcagaaaacccataggtttttgctttaaagcaaaagagagtttaaaaacaacaaaatccacaactgaactttcagaaaagtgtgaagatccaaaacagctttgtctccaaagaagatagctctgtgaccactatggatagtttcctgcgcattgtcttgtcaggtgggagatctggaacatacatgcaggacgctagactgttgggacagacattttccaacaaacaaggggccaaaatatctgcaatatagtaacagccttaataatacatgcattttcattttctacagctgttctcaactatgtccacaatgtatcatcacctccatactcatagctgtattcaaacaggaccttttggttgttttgaaatgtttctgaaccccctcttgcctcctgacacagcatcattgtgacattcttcccagttgtgttaggcctttgtcccaggccgtccattggtctgtcagcaatactcagcgcaaagcagagcgagaagcattgtgtctctgaagtaaagaaagtgatggtcatattataaagatatgttcctctttaatacatcggtgtaaccctttgagaactatcagaccagcttacagagtcaggatgatcagtcttgcaatctggtcatttgtagaagtggccaaaagggaaagccatcacatgttcgagaagttcagacttgtaaagcataccttacaatcccatgtaattctttaatgactgacagtactgcataaatgcttttataacaaacaacagtggtgtgacttgccaaaacttttctggcaaataaaaaagatattttgttaacaat

SEQ ID NO: 35 - DNA, 525 bp, Rattus norvegicus
gcaggtcccagaggcccagttggtccacatggacctcctggaaaagatggatcaagtggacatccaggtcccattggaccaccagggcctcgaggtaacagaggtgaaagaggatctgagggctcgcccggtcaccctggacagccaggaccccctggaccccctggtgcccctggtccctgctgtggtggcggtgctgccattgctggagttggaggtgaaaagtctggcggcttttcaccatattacggggatgatccaatggatttcaagatcaacactgaggagatcatgtcttcactcaagtctgttaacggacaaatagagagtcttatcagccctgatggttctagaaaaaaccctgctcgcaattgcagagacctgaaattctgccaccctgaactcaagagcggagaatactgggttgatcctaaccaaggctgcaagatggatgctataaaagtgttctgtaatatggaaaccggagaaacatgcataaatgccagtcccatgactgtcccgcgg

SEQ ID NO: 36 - DNA, 3015 bp, Rattus rattus
cgcaagccggggagcgctcggcccagaattagtggatggatttggaatctccctgcctcctccaagctccgccactgccactttaggcagagacctgagcgtcaacacgcgagccgtacttttaggctgcggacactgagcccagcgcgccagcttcgcatctccgcaccaggctccacagctcggagaggcatgaacgcgatccggaggagactaccctgcgcgcggggatccgtggacattagccgctctcgggaactgacccccagctccttcagccatttatgaatccagaggcttgagatttttttccgcatcccggagcccgacctgagaaatttcaatgaaaaggaaagtcaatggatcgtggtgttggaaaagctgcttagacatgtctgtttcccggctctctgaacccgtggcagagctgtaagtaagcgcttcacagtgcgtgatgaattggatggcttcggacccgaggcaaaaaaaataattgtctcattttcgtgctgatttgcttaactggtgggaccatgccagaaaggctagctgagacgcttttggacctctggactccattaataatattatggattactcttccctcttttgtgtacatggctccgatgaatcaggctcacgttttaactactggatcccctttggaactaagcaggcagagtgaagaaatgcggattttgaaccgctccaaaagaggttgggtttggaatcaaatgtttgttctggaagaattttctggacctgaaccgattctcgttggccggttacacacagatctggatcctgggagcaaaaaaatcaagtatatcctatcgggtgatggagccggcacaatctttcaaataaacgatataactggagacatccatgctatcaaaagacttgaccgagaggaaaaggctgagtatacgttaacagctcaggcagtggactgggagacaaacaaacctctcgagcctccttctgaatttattattaaggttcaagacatcaacgacaatgcccccgagtttctcaatggaccttaccatgctactgttccagagatgtccatcttgggtacatctgtcactaatgtaacggccactgatgctgacgatccagtttatggaaacagtgcaaagttggtttacagtatcttggagggacagccgtatttttccattgagcctgaaacagctattataaaaactgcccttcctaacatggacagagaggccaaggaggaatacctggttgtaattcaagccaaagatatgggtgggcattccggtggtctgtctggaaccacgacactcacagtgacgcttaccgatgtgaatgacaatcctccaaaatttgctcaaagtttgtatcacttctcagtaccagaagatgtggtccttggcactgcaataggaagggttaaagccaatgaccaggatattggtgaaaatgcacaatcttcctatgacatcattgatggagatgggacagcactatttgaaatcacttctgatgcccaggcacaggatggtgttataagactaagaaagcctctggactttgagaccaaaaaatcctatactctgaaggtggaggcagccaatatccacatcgacccacgtttcagtggcaggggaccctttaaagatacagcaacagtcaaaattgttgtagaggatgctgatgagcctccggtcttctcttcaccgacttacctccttgaagttcatgaaaatgctgccttgaactctgtgattggccaagtgacagctcgtgaccctgatatcacttccagcccaataaggttttccattgaccgccacactgacttggagagacagttcaacatcaatgcagatgatgggaagataacactggcgaccccactggacagagaactaagtgtgtggcacaacatctccatcattgctactgagatcaggaaccacagtcagatatcgcgagtgcctgttgctattaaagtgctggatgtcaatgacaacgcccctgaattcgcgtccgaatatgaggcatttttatgtgaaaatggaaaacccggccaagtaaatatctccatgttgttaatactgaatatgtttgtatacaactgtttcctagttaattaacctgcattacttcctgattttgcattggttggatttacaaagtcacaggcaggaaactcctccaagcggtaacagaagggaatatttgtctttctcagatgttaattctcttctaacttaggaaccaattggctcagaaagtgtgatgatctgctctgctctgaccccagccaaatcactgtcttaaaatacatcacatatgggtgatggctggggacagtcttacagtgcagaaggttgaaatcgccatcaattggcaagaatctaaagaatagctcatgggaagcatgcatttttgttttatgttgaaaagaagattaatgcacaaatgtggaatgcaaaaaaacacagtagtttatagaaagctctatgtagtggtacttatgtctgtacacatatttgcaagtttagtaaacataatgtagacatcaaattgttagatatgcccctaaggcatttcaatatgtagaggtaagactcctaaggcatagatggggataatgaagacaaaaataaagggcagaaaaatgtataaaatagaacagacagaaatacactaaagatctaaagatagaagcaggaaagaggggagggagggagggagacagggctggaagaagatagggtgggagggagggaaggagagtcaaggctcagggtgtggggggaaggtaaaatgcaaaacaaaatctacagaaaccactatactctgaatgtcaaaatgcaactaacctatgtaaaatcacccaaccacatgtgtaatagatttattttaacgaggtgccggagtactgtatgtttaagaaatttatcatttttcaacttcctaatttatttctggatggtgacattttaatttaaataaacagcagctgacagcatg

SEQ ID NO: 37 - DNA, 3617 bp, Rattus norvegicus
ttctgccccttgtagctgttctgccctcccctttaaaggttgacttgccccgcggcgctccaccgcgctctagtcctctgacgcctccggctcaaccctttgcaacgcggatccccgcccgcctgactgcccgcgcagcgcagttccagcagcaaagcagaagggcgcgccgagatggagagcaaagccctgctcctggtggccctgggagtttggctccagagtttgaccgccttccgcggaggggtggccgcagcagacgggggaagagatttctcagacatcgaaagtaaatttgccctaaggacccctgaagacacagctgaggacacttgtcatctgattcctggattagcagactctgtgtctaactgccacttcaaccacagcagcaaaacctttgtggtgatccatggatggacggtgacaggaatgtatgagagttgggtgcccaaacttgtggctgccctatacaaaagagaacctgactccaatgtcattgtagtagactggttgtatcgggcccagcaacattatccagtgtctgccggctataccaagctggtgggaaatgatgtggccaggttcatcaactggctggaggaagaatttaactaccccctagacaatgtccacctcttagggtacagtcttggagcccatgctgctggcgtggcaggaagtctgaccaacaagaaggtcaatagaattactggcttggatccagctgggcctaactttgagtatgcagaagcccctagtcgcctttctcctgatgatgcggatttcgtagatgtcttacacacatttaccagggggtcgcctggtcgaagtattgggatccagaaaccagtagggcatgttgatatttatcccaatggaggcactttccagccaggatgcaacattggagaagccattcgtgtaattgcagagaaggggcttggagatgtggaccagctggtgaagtgctcgcacgagcgctccatccatctcttcattgactccctgctgaatgaagaaaaccccagcaaggcatacaggtgcaattccaaggaggcctttgagaaagggctctgcctgagttgcagaaagaatcgctgtaacaacgtgggctatgagatcaacaaggtcagagccaagagaagcagtaagatgtacctgaagactcgctctcagatgccctacaaagtattccattaccaagtcaagattcacttttctggaactgagaatgacaagcaaaacaaccaggccttcgagatttctctgtatggcacagtggctgaaagtgagaacattcccttcaccctgccggaggtcgccacaaataaaacctactccttcttgatttacacggaggtggacatcggggaattgctgatgatgaagcttaagtggaagaacgactcctacttccgctggtcagactggtggagcagtcccagctttgtcatcgagaagatccgagtgaaagccggagagactcagaaaaaggtcatcttctgtgccagggagaaagtttctcatctgcagaaaggaaaggacgctgcagtgtttgtgaaatgccatgacaagtctctgaagaagtcgggctgacactggacaaaccaacaagagaagaaagcatctgagttctttgaagaccgaagaaaatgaagtaaattttatttaaaaaaaatacccttgtttgggtgtttgaaagtggattttcctgagtattaatcccagctatatcttgttagttaaatagaagacagtgtcaaatattaaaaggtggctaacacaacgtgaggaacctaatggccgatagcatgtcctccagcatcagaagacagcagagaggagaagcatgccatcttatatcccttaagaaggaatcatttgttcccaaccatacaagactccttcatgtgacccatttggtcatggtctaaaattagtaagggcctcttattttcattagatctctgaggttttaaattgagaccttctcaaagttctcttgaagtctaatatagacaacatttttttgtgctgtgagtcagatccatttctttagcagttgaaacagctggccattgtaactagttcttttaccatcaggatatagcacccctaccaaataaaataaataaataaagtgaccagggacatgtgactttgcaaaagcaatggacgacgtggctcgtggattcctgacccttagtcccaccacaacgaagtacaagtcagtagaggtacaaaacctagactgagtaattcttagtagacttcaagttttatggcttaattcctctgtcttttaaaaacgtgtcacatattataacattattctctagacagatgttgaaatgagcttgtgattcaggtgacatatgaattgagctgagagaaaataatgccctggctgattttatttctctgttttgctttcttgagaaaaggaatacttgtcccactccgtatctgagcctgaccaagaactaaactatgtacttcaggcttaccttgaactctcaaccatcctgccttggcttcctgagtgctgggagcttgataaccataattttattatcagatttttcttagtcattttcaccaatagaacacattcaatgcccaatcgttagcatttcgtttgagactcatcttgaccgtacctctgtcacacgtctaacacatcacattaatttctagtttagaagtgatcaagttcaaattctgcactgcgcaaagtacaagttttagagcaggaccattttttttttaccacgtaaaagtcgaaattactaggaaatgtgtatatcgatgcttgtacactgttgcgtgcaaagtgaggagccttctattgtgatagccatagacagtaccaggctcgttgccgctcttttgttttactataaaaaaataatgaagaattatttatgaacaagatctcatatgttcagattgcttttactattcatcaatataaaatgttaaaaaaaaaaaataaaacaagttctatctcagaggctgttgctgggaacagaaactgtgaaatgtgtgggtatctgaacacctacacacaagcaaagccccacaagagtctttgtcattcaatgtcattcagaaaggaaagagtcaagagatataccataatatgtcagagaagtagttccagatatgctggaatgctagcccttgctaggagaaagttggttgtgcctatgtaatataggacaaaagtgactggtttcattaggctcagtgtcattctaacaataaaatgatgtaccatatgtcaccagcatccccattattgctaattcatggcagtatatacgtacatatctcaatgatgctttgactttaaattttatttattagctgtaaataatgtgtgggtgtgtaaggaagcttgtaaacactggaaacgctgttgtggctatctggggtgtagatttgtggtgctaactctgtgtccacctccatcagtgattgtctcactgagccaactcactctgatgaacagcacaatggaatagcttttgaaggaagaaaataaactcacctgtgtgaagaaatgggatctgctttcaataaaatcgagaacgttttatccggaatccgcg

SEQ ID NO: 38 - DNA, 1205 bp, Rattus norvegicus
ggcttcgttggtgctggaccccaggctgggcagcgtctatgccctcaagcaccatgcagctccttcttgctctactggcgctggcttacgtggccccctctactgaagattcacactggtgctatgagattcaagccaaggagcccaacagccattgctcagggcctgaacaatggactggagactgtaagaagaaccagcagtctcctatcaatattgtcactagtaagacaaagttgaaccccagtctgacacccttcactttcgttggctatgaccaaaagaagaagtgggaagttaagaacaaccaacactcagtggaaatgtcgctgggggaggacatctatatttttggaggagatctgcccacccagtacaaggccatacagttacacctgcactggtcagaggagtcgaacaagggttcagagcacagtattgatgggaaacattttgccatggagatgcatgtcgtgcataagaagatgacaacaggcgataaggtgcaggactcggactccaaggacaagattgcggtgctggcattcatggttgaggtgggaaacgaggtaaacgagggcttccagcccctggtggaggcactgtccaggctctccaaaccctttacaaactccacagtgagtgagagctgcctgcaggatatgcttcctgaaaagaagaaactgtctgcctacttccgttaccagggctcactgactacaccaggctgtgatgagactgtcatctggactgtgttcgaggaacctattaagatccataaagaccagttcctggaattctcaaaaaagctctactatgaccaagaacagaagttgaacatgaaggacaatgtgaggcccctgcagccactgggaaaccgccaggtgttcaggtctcatgcctcaggacgactgctgtctttgcccctgcccactctattggtccccacactcacctgcctggtggccagcttcctccactgatggtcaaattctggatatctggcctctgacctcaacctttagaggatatggcttctctttctcaatctttccaggttgaactttggggactattaaggtgtgctgtggtggtgcacacctttaatcccagccctggatggagagagcagagacctatggatctctgaccttcccctaacccctgattaaattaaataaaatatggatatgtttttactctta

SEQ ID NO: 39 - DNA, 506 bp, Rattus norvegicus
  misc_feature (459)..(459): n is a, c, g, or t
  misc_feature (489)..(489): n is a, c, g, or t
tttttttttttttttttggtaggtgattttctttaataattttgttaaaaactccagtttttttcccagagatatcagcttctttatgcagctagctccccctctgatcctcaagactatccagatttagggttggggttatcaatccaatttattaagtcctcagggaggaggaaggccacatccttccatcatagaccctttggccatcttgacagtttctgctttctcctgtctactcagatctgcctttgattcctcagagagagggatctgctgtcttgtgtgccctgaaattaacacccaaaaagagactagaaatcctcagggtgtttcttaggtctcctcaggaacagccagggacagaatgatcctaagtatcaggccaggcacagcaagctggagcaggggtagaacagactaaagttctttaccacaaaggaggggaccacactgtanagggaaaataaatagaatagcccagggtancagaatccaggcccccc

SEQ ID NO: 40 - DNA, 912 bp, Rattus norvegicus
tcccgcggggtggcgggagcgctgcggcccctgctgcaaagcgcggtgcccgccacctcggaaccaccggttctggacgtgaagcgacccttcctgtgccgtgagtcgctgagtggccaggccgcgacccgtcctttggtggccacagtgggcctgaatgttcctgcttctgttcgttattcccacacagacatcaaggtgcccgacttctctgactatcgccgtgctgaagttctagatagcacaaagtcttctaaagagagcagtgaggctagaaaaggcttctcttacttggtaactgcaactactactgtgggtgttgcatacgctgcgaaaaatgcagtctcccagtttgtttccagcatgagtgcttctgcggatgtactggccatgtcgaagatcgagatcaagttgtctgatattccagaggggaagaacatggcttttaaatggagaggcaaacctctgtttgtgcgccatagaaccaagaaggagattgaccaggaagctgcagttgaagtgtcccagttaagggacccacagcatgatttagagcgtgtaaagaagcctgaatgggttattctgatcggtgtctgtactcatcttggttgtgtacccattgcaaacgcaggagattttggtggctactattgcccctgccatgggtcacactatgatgcttctggcaggatcaggaagggccctgcacctctcaacctggaagtacctacctatgagttcaccagtggtgatgtagttgttgtgggttagacacttggactgagggcctaggtttctttcggtcttcatgtcccctcagaagagttgagagtaagccttgtacttctaggttggttgatttaaaatatttaagaattgttaataactattggcaaacattaatgtgaagta

SEQ ID NO: 41 - DNA, 2325 bp, Rattus norvegicus
tttttttttaggagcccgcgcctcggtttcagcggacgcttcccctgatctccgttctaccaccatccactgccgtcttaccacccaccatggccctcctgcactccggtcgcgtcctctccgggatggctgctgcctttcacccaggccttgcagccgcagcctctgccagagccagctcctggtggacccatgttgaaatgggacctccagatcccatcctgggagtgaccgaagccttcaagagagataccaacagcaagaagatgaacctgggagttggtgcctaccgggacgataacggaaagccttacgtgctccccagtgttcggaaggcagaggcccagattgctgggaaaaatttggacaaagaatacctacccatcgggggactggctgatttttgtaaggcttctgcagaactggccctgggcgagaacagcgaagtgttgaaaagcggccggtttgtaactgtgcagaccatttccgggactggagccttgagggtcggagccagctttctgcaaagattttttaagttcagccgagatgtctttctgcccaaaccatcctggggaaaccacacgcccatcttcagggatgccggcatgcagctgcaaggttatcgatactatgaccccaagacttgcggctttgacttctctggagccttagaagacatatcaaaaatcccagagcagagtgttctccttctgcacgcctgcgctcacaaccccacgggcgtggacccgcgtccagagcagtggaaggaaatggcggcggtggtgaagaaaaagaatctcttcgcattctttgacatggcctaccaaggctttgccagcggcgatggtgataaggacgcctgggccgtgcggcacttcatcgagcagggcatcaatgtctgcctctgccaatcctatgccaagaacatgggcctgtacggtgagcgtgtgggagccttcactgtggtctgcaaagatgcagaagaagccaaaagggtggagtcacagctgaagatcctgatccgccccttgtattccaacccgcctctcaatggagcccggatcgccgcaaccatcctgacttctccagacttgcggaagcaatggttgcaggaggtgaaaggcatggctgaccgcatcatcagcatgaggacccagttggtctccaacctgaagaaagagggctcgtcccacaactggcagcacatcaccgaccagatcggcatgttctgcttcaccggcctaaagcctgagcaggtggagcggctgaccaaggagttctcagtctacatgacaaaggatggtcgaatctctgtggccggggtcacctctggcaatgtgggctacctggcccacgccattcaccaggtcaccaagtaatcaccaggtgcaaggaaacagagatcactttcccttcagcctttgctctcatgagagtcacgtgcagggtgagggagggtggatggtgttgagtagatcctgttttcaaccacggtgcataactcctgtcgattgaacgcgttcctcggaaaagaggtagggcagaggctcccacggctgatatctggaacttcgtcggctctaaaccaaactctccctcatccttttgtctccagcttttctgaaagtttacacatgcaaaaaaatcacagcaccaaaacctgtcagcatggcataggcacaggtcagaagctttacctgaagcctcaggtggtgtcaggggttcccctgtggaccccggtagagcctctcatattagaggctgtaagagaagaataactagttctgtcattaacagttgtcgagtgtgtcctcgtggtgtggagcaactgtgtcagcagaccacattatggaaattatgctttacaaaaaccaacagggacagtagaagatgtaatgtcttgtcatggctgttctgtagcctggagtttcatcccattctactgctcggttgaccatcaacctcatccttaggagtgatctaagaataaagaatgtagtttttctgttcatgccataaccttctgtctcagcaaagagccggggagagtgggaccctgcccttgatttcagagtcctcttcagtgattgattggctcctacgggggtggggcctctgcccagctggacgtcctcattcatcctgactgcagcctgtcttcacatgagtcagacatgcagggtaggatcggaaggagctattctggggtttgtatgctaccagcccggctcagactcagcccttgggaaagataaccaccatctgctctaaccgtgtagacgtacctggttttctctgttacaataaaattactacagaccc

SEQ ID NO: 42 - DNA, 1607 bp, Rattus norvegicus
ggatgcagagcatcagaggcccagctagagggacaacacagaggagtaatttgctgacagacctgcagggatggacctgctttcagctctcacactggaaacctgggtcctcctggcagtcgtcctggtgctcctctacggatttgggacccgcacacatggacttttcaagaaacaggggattcctgggcccaaacctctgcctttttttggcactgtgctgaattactatatgggtttatggaaattcgatgtggagtgccataaaaagtatggaaaaatatgggggttgtttgatggtcaaatgcctctgtttgccatcacggacacagaaatgatcaagaatgtgctagtgaaggaatgcttttctgtcttcacaaaccggcgggattttggcccagtggggattatggggaaagctgtctctgtagctaaggatgaggagtggaagagatatagagccttgctgtcccccacgttcaccagtggaagactcaaggagatgttccccatcattgaacagtatggagacattttggtaaagtacttgaagcaagaggcggagacaggcaagcctgtcaccatgaaaaaagtgtttggtgcctacagcatggatgtgatcaccagcacatcatttggagtgaacgtcgattcccttaacaacccaaaggatccttttgtggagaaagccaagaagctcttaagaattgatttttttgatccgttgttcttgtcagtagtactctttccattcctcacgccagtatatgagatgttaaacatctgcatgttcccaaaagattcaatagaatttttcaaaaaatttgtgtacagaatgaaggaaacccgcctggattctgtgcagaagcatcgagtggattttcttcagctgatgatgaatgctcataatgattctaaagacaaagaatctcatacagccctatccgatatggagatcacagcccagtcaatcatttttatttttgctggatatgaacccaccagcagcacactttcctttgtcctgcattccctggccactcacccagatacacagaagaaactgcaggaggagatcgacagggctctgcccaataaggcacctcccacctatgatactgtgatggaaatggaatacctggatatggtgttgaatgaaaccctcagattgtatccaattggtaatagacttgagagagtctgtaaaaaagatgttgaaatcaatggtgtgtttatgcccaaagggtcagtggtcatgattccatcttatgctcttcaccgtgatccacagcactggccagagcctgaggaatttcgcccagaaaggttcagcaaggagaacaagggcagcattgatccttatgtatatctgccctttggaaatggacccaggaactgcattggcatgaggtttgctctcatgaatatgaaactcgctctcactaaagttctgcaaaacttctccttccagccttgtaaggaaacacagatacctctgaaattaagcagacaaggacttcttcaaccaacaaaacccattattctaaaggttgtgccacgggatgaaatcataactggatcatgattttccctcaaggagttctgct

SEQ ID NO: 43 - DNA, 3448 bp, Rattus norvegicus
ctgatgagcgcagttcatacaggaagggtgtctggaagccggcttgccatcctcatgaagactgccgaggagaacttggaccgtagagttccaatccccgtggatcgtagttgtggaggattgtgagtctgaccaataaatccacaaccaacaagcctaggacagtcagcactatgtacaaccagagacgacttaaaccactctaaaatagtggccattgtagctgccttttttttttttttttttaaaaaaaaaaaaaaaacaaacaagggaaaaacagcaaaattcaaaaaaaaaaaaaaaaaaaaggaaaaggaataagcaagcaaacaaacaaaaacactggaaaacattccaaaactttaaagatgttggtgtgctcgccaacacattttgccaatactttatttgtatctgccatgaagtctagcttcaacaaagagctttttttttttagtgcacattgatttaatgttttgtatccatttttgtaacctgtcagacttgacactctgcctgtccattcattcattcattcaaacaagttttagaggcagactccctatagatcggaaagattttgcgagcgcccaaacggtcaggagccggagctcgtagacaacgtttttttttttttctaaaaaatcatttgacctcttaacgtgataatgttttggggagacttctcaaccctgtcttgctacccaaccccttacaattaacaccgtatacttttctgtctggagtaactctggctaatctggagagggaagacaaagtttagatctggttgagatttggttacgtttctaaaagaagaactccgaaagcttccagacttgcaggcgtaagataaagacagcgttgacatttgccgggaggtacggcgatagctgcttctcagctatcatttttccccctaggcactgctggctttctttgactattatagttgccagaaaaatccttgctttttttactttgaaaccagcatttgaatggcaagttggatataatgggatgagaccaaatctttccattcctcacgggagtaatgatagaacacaatttccaatcccacaagtgccgaatcttgcagcctgtggtgttgtcaggcctgttcttgtcgggggtgggcagtagtggtggcatttgcaaagagctaataaaaacgaattgggcagacttccgttaactttaattatgaaattaaaataaggaatgccacttttatattggaagctggtctgtttgccaaaagtctttctctttgagtactcaatgggaaaattctctttctaacaaaaaataaaataaattaaaaatcaaagaaagacattagacacacacacacacacacacacacacacacacacacacaaatcaaacccaaaagtcagtgcccattgaactcaacagatagtgcacagaacagaggtaccttgccagttggaagatgtttttgttatagtctgttggcgttataactaatagtcttagtacttactaattggcctcccatctctgaagctaccaacagttagcttcctgtgcatagtaggacgtgtagctcttcgttcacacttctctcctgtcgttcacacttttctcctggcagcctttgttgcacagaccacgtcctagccttgtgaactggtacataaaccacctttgtgctactgttccgcttatgcacacattgtgtctttctgcctcattcattctgggtcatgaatatcatatcatataatgtaagctgggaggttctcagtccccgcctcacaccctccccctcccccacccccacgccctccccatcccatacccctgaaatatgcagagagactgcagggagagacactcaactcgttattaaatgaagtatagatgcttccacttctgtgtcagggaaacctaagtgatgtcacagcaggtgtcactgtgaattcttttctttccaagtgtcaattttttacactggtttgtatttttttttttaaatagatggaagcatgtggctttgcaatttagtgggattttttttttctatcatgacaataaagttcactttatacctcgtgacagtcaagtcggcagaaaagctatcctttaagacatccctttaagatctgtgcagatatatcacaatattctacatcgctacttcctctctctttctctctctttctagttagatcaagataacggtggcttgtgtcatccctgattctcttacagtagggactgggctcagaatgtgacttgattaggctgatctgcacttggaaagcaggtcttgtctgtatatgccttgctctgaacgaagttcccttaaggacaaagggaagcgcactgtgcttcgtttgagcttctctgcctgggcttggtatctgctcattctaaaacacgctccttcaccagtccctgagactctcggaaacgagctcctttttaatcacactcccatgagtaaagcaccccagaatttctctatgagttcccaatgaaacctgtacaggtttttaaattttaaatccaatttaagccaagaggaggaaggaactcaggggaagaagccccttcagaaactcctccagagaataaaccgtgtttgtcttttcccataaaactgctatttgttgattttgtttggctgtgggagggggtgagaggagatcaccttttatcatcaggtgatttatttcctcctgacgggattcaggtgaaggaagcccatctgttctggagagctgtgtatgcctttaactagcctccgtcccattgcttgaacagtcattactggcttagctacggttgctgcctcagtcatcatgctgcatattcctgctttcccgtatgttcatactgagtgtgacaccggatctctgctctcgggtgcatgcttcgtactctgcctcagcttatgccttgatttttgtccatttcaaaatacgcgcaacaaaaaatgttcattctgattttaactcagttcagcagagaggttgtcattgacctttcccccctctttccctcttttttatccgtaaaggtctttttacatatgaatgtaatcacgtccatgacaccaatgctgtaaactctgcactgcagtttactctaaggagtgaaaaagccctactgtgttttaaaagaatcccctctcttagtccagtcctggagtggatgcacgtgctgcacgctctctcactcgcacagtttttatgtattgtgttgggttatcgttctagactggactgttaaatgctgtctgtgaggctggactgtcatttttataactgtcttcgtattttatcgccattatttattacttttgatatacagaatgagccgcatgcatttatagagcaataagaagatgtatttaatgtgccttgtttttaactgagtaagagctgaaagcatgaatcaataaaactgattaaagtgg

SEQ ID NO: 44 - DNA, 2225 bp, Rattus norvegicus
accagatggcccaaagaggaggcctaggatgcaccccatgacaggtctgtgttccaggagggggaggaggggcatcctcaggctcctgcttcccatctcttcccccaaacagtgatgcctcgaacagtggcatgttgcctcgacttggtgacctgcttttctacaccattgcagaggggcaggaacgcatccccatccataagttcaccacggccctgaaggccactggactgcagacgtcagacccacggctccaggactgcatgagcaagatgcagcgcatggtccaagagtccagcagtggtggcctcttggaccgagaactcttccaaaagtgtgtgagcagcaacattgtgctcctgactcaggcattccggaagaagtttgtcattcctgactttgaggagttcacaggccatgtggatcgtatatttgaggatgccaaagagctcactggaggcaaagtggcagcctacatccctcacctggccaagtcaaacccagatctttggggcgtctccctgtgcactgtggatgggcagcgacactctgtgggccacacgaagatccctttctgcctacagtcctgtgtcaagccactcacttacgccatctccgtgagcaccttaggcaccgactacgtgcacaagttcgtgggcaaggaacccagtggtctgcgctataacaaactctccctcaacgaggaaggaatccctcataaccccatggtcaatgctggtgctattgtggtcagctccctgatcaagatggactgtaacaaagcagagaagtttgactttgtgttacagtatctgaacaagatggctgggaatgaattcatggggttcagcaatgccacattccagtcagagaaggagactggggatcggaattacgccattggctattacctcaaggagaagaagtgcttccctaacccagtggacatgatggctgcccttgatctctatttccagctgtgctctgtggaggttacctgtgagtcaggcagtgtcatggcggccactcttgccaatggcggcatctgccccatcacaggggagagcgtgctgagtgcggaagccgtgcgcaacaccctcagcctcatgcactcctgtggcatgtatgacttctcgggccagtttgccttccacgtgggcctgccagccaagtcagctgtgtcgggagccatcctcctggttgtacccaatgtcatggggatgatgtgtctgtcacccccgttagacaagctggggaacagccacaggggcatcagcttctgccagaagttggtgtctctgtttaacttccacaactacgacaacctgcggcactgtgctcggaagttagacccacggagggaagggggggaagttcggaacaagaccgtggtgaacctgttatttgctgcatatagtggagatgtctcagctcttcgaaggtttgccttgtctgccgtggatatggagcagaaggactatgattcccgcacagccctacatgtggcggcagcggaaggacacattgacgttgtcaagtttctgatcgaggcttgcaaagtgaatccttttgtcaaggacaggtggggcaacattcccctggatgatgccgtgcagttcaatcacctggaggtggtcaaactgcttcaggattaccatgactcctacatgctgtctgagactcaagctgaggtagcagctgagactctgtcaaaagagaacttagagagcatggtgtgagcacaggccaggggcagcccctgctcaagaaaaagcatgagccggccacacatttaacccaaggccaccaaaaatactattgcaagctgcttcagtggggatcaacacagccatctggtgacacaggccagtgttttctgtgagaatcaaaatgccccattccctcatcggacagcacagagaaaagcttcagtggacacctgagcagagctagccacggagacctcaaggtatagcttaagtgacatcctccaccagaaagtagcccaggcttttacccaggtccccatttcaacttccttggagagcctctagctacatgcatatgtatctgtcacagagcaagagaggtgggtgagagcccaatcacctggctttagaaatctgcagagatctgtccatcttagccaagacatgctgctactgctgacaggagttttatagacaaagtattttgtgttcaaataaactttaattaccggaatt

SEQ ID NO: 45 - DNA, 1463 bp, Rattus norvegicus
cgcgcttgcctagtgaagctgcgaacgtgtgggaggctgcactcactcgaggtcctgagttgcgcggagctgcttctgctagggcgatcgcctccctgcaatcatgttcctgaggagcagcgtctcccgtctcctccacgggcaaattccttgtgccctgacgagatccgtccactctgtagctgtagtcggagcccctttctctcggggacagaaaaagaaaggagtggaatatggcccagccgccatccgagaagctggcttgctgaagaggctttctatgttgggatgccatataaaagactttggagacttgagttttactaacgttcccaaagatgatccctacaataatctggtcgtgtatcctcgctcagtgggcattgccaaccaggaactggctgaggtggttagtagagctgtgtcaggtggctacagctgtgtcacactgggaggagaccacagcctggcaatcggtaccattagtggccatgcccgacaccacccagatctctgtgtcatctgggttgatgctcatgctgacattaatacacccctcaccactgtatcaggaaatatccatgggcagcctctttcctttctcatcagagaactacaagacaaggtaccacaactgccaggattttcctggatcaaaccttgcctctctcccccaaatcttgtatacattggcttacgagatgtggagcctgccgaacactttattttaaagagttttgacatccagtatttctccatgagagatattgatcgacttggtatccagaaggtcatggaacagacatttgatcggctgattggcaagaggaagaggccgatccacctgagctttgacatagatgcatttgaccctaagctggctccagccacaggaacccctgtggtaggggggctgacctacagagaaggactgtacattactgaagaaatacatagcacagggttgctgtcggctctggatcttgttgaagtcaatcctcatttggccacttctgaggaagaggccaaggctacagccagcctagcagtggatgtgattgcttcaagttttggtcagacaagagaaggcggacacattgcctatgaccaccttcctactcctagttcaccacatgaatcagaaaaggaagaatgtgtgagaatttaggaaacactgtactctggcacctttcacgacagcattccagagttgggaggcatttaaagggacaaagagtaaatggctgtctggatccaatattgccttaatgagaacatctgtgcactctcacaagtgtagagtccccttctctattttggtcacaatactatcactgtaaatgtatctgttgggtttttgtttctgaagtttacaagctattgttattatacacgtgtgtttgaaggagtcataaacagcatttattaccttaaaaaaaaaaaaaaaaaaaaaaaaaaaaaaa

SEQ ID NO: 46 - DNA, 771 bp, Rattus norvegicus
gccagggcgtccggcctcaccgctcagtggggaagacatgcaaggaatttgcataagacagcagtgcaaaatggtgctggaggagccttatttgtgcatagagatactcctgagaataacccagatactccatttgatttcacaccagaaaactacgagaggatagaggcaatagtcagaaactacccggaagggcacagagcagcagctgtgcttccagtgctggacctggcccaaaggcagaatgggtggctgcctatctctgccatgaacaaggtggcagaagttttacaagtgcctccaatgagagtctatgaagtggcgactttttacacaatgtacaatcgaaagccagttgggaagtaccacattcaggtctgcactactacaccttgcatgcttcgagactctgacagcatcctggagacccttcagagaaagctgggaataaaagttggagagactacgcctgacaagcttttcactcttatagaagtagaatgtttaggggcctgtgtaaacgcaccgatggttcaaataaacgacgactactacgaggatctgacacccaaggatattgaagagattattgatgaactcagagctgggaaagttccaaaaccagggccaaggagtggccgcttctgttgtgagccagccggaggccttacttctttgactgaaccacccaaaggacctggctttggtgtgccagcaggcctttaacttacattcaactgtaaaaatgtcactggagaaataaaatatgaa

SEQ ID NO: 47 - DNA, 1360 bp, Rattus norvegicus
  misc_feature (1)..(2): n is a, c, g, or t
  misc_feature (1122)..(1122): n is a, c, g, or t
nntgagttctgcgaaaggttctcctactatgggatgcgagctctcctggttctgtacttcaggaacttccttggctgggatgatgacctctccacggccatctaccatacgtctgttgccctccgctacctgactccaattcttggagctctgatcgcagactcgtggctggggaagttcaagacaattgtctcactatccatcgtctacacgatcggacaggccgtcatctcagtgagctcaattaatgaccttacagaccatgaccacgacggcagtcctaacaaccttcctttgcacgtagcactgtccatgatcgggctgggcctgataggccttggtacaggagggatcaagccctgtgtgtctgcatttggcggcgatcagtttggagagggtcaagaaaaacagggaaacccggtcttttccatcttttatttggctatcaacgcaggaagcctgctctccacgatcatcactcccatactcagagttcagcagtgcggaatccacagccaacaagcttgttacccactggcctttggggttccggcagctctcatggctgttgccctaattgtgtttgtcctcggcagtggaatgtacaagaagtttcagccccagggcaacatcatgggcaaagtggccaagtgcattggctttgccatcaaaaacaggtttcggcaccgaagtaaggcatttcccaagagggaacactggctggactgggctaaagagaaatacgatgagaggctcatctcgcagattaagatggtgacgaaggtgatgttcctgtacattcccctccccatgtcttgggccttgtttgaccagcagggttccaggtggacactgcaagcaacgaccatgactgggaaaattggaacaattgagattcagccggaccagatgcagacggtgaacgccatcttgattgtcatcatggtccccattgtggacgccgtggtgtatccgctcattgcaaaatgtggtttcaactacacctccctgaagaagatgaccgttgggatgttcctggcatccatggcctttgtggtggctgcaattgtgcaggtggaaatcgataaaactcttccagtcttccccagcggaaatcaagtncaaattaaggtcttgaacattggaaacaatgacatggccgtgtattttcctggaaagaatgtgacagttgcccaaatgtctcagacagacacattcatgactttcgatgtagaccagctgacaagcataaacgtgtcttctcccggatctccaggcgtcaccacggtagctcatgagtttgagccgggtcaccggcacacccttctagtgtggggccccaataactaccgagtggtca

SEQ ID NO: 48 - DNA, 2730 bp, Rattus norvegicus
accgggtccttagggaaccagccatggagggcgagcgggcgccgctgttaggttcgcggcgtgcggcggcagcagctggggtgtttgcggggcgtcgtgcggcgtgcggggcggtactgttggccgaactgctggagcgcgcggccttctacggcgtcacggccaacctagtgttattcttgaatggcgcgccgttcaactgggagggcgcgcaggccagccaggcactgctgctcttcatgggcctcacctacctgggatccccgttcgggggatggctcgctgacgcgcgactcggccgggcgcgcgccatcctgctcagcctggcgctctacctgctgggcatgctggccttcccgctgctggccgcgccccgctcgcgctcttttctctgcggggatccgcacccggagctggtgcgcaactgctcggctcccttccctaacggaacggcggtctgtcccgatgctgccgcgcgccgctgtgctcccgccaccttcgcgggtctagtgctcgtgggactcggtgtggccacggtcaaggccaacatcacaccctttggagcggatcaggtcaaagatcgaggtccagaggccactcggagatttttcaattggttttactggagcattaatttgggagcaatcctgtcattaggaggtattgcctatattcagcagaatgtgagctttctcacaggctacctgattcctacagtctgcgtggccattgctttcctggtcttcctctgtggccagagtgtcttcatcaccaagcctcctgatggcagtgccttcactgacatgttcaggattctgacctacagctgctgctcccagagaggagggcagcggagaagtggtgaaggccttggagtctttcagcaatcttctaaacacagtctgtttgattcatgtaagatgtcgcgtggagggccgttcacagaggacaaagtggaagacgtgaaagccctggtcaagattgtgcccgtgttcttggctctgattccttactggacagtgtatttccaaatgcagaccacatatgttttacagagtcttcatttgaagattccagaaatctcaagtatcaccaccacccatcacacgctgcctgcagcttggctcaccatgtttgatgcggtgctcatcctcctgctcatcccactgaaggacaagctagtggacccggtgctgaggagacacggcctgctcccatcctccctgaagaggattgccgtggggatgttcttcgtcacatgctctgcctttgctgcaggaatcctggagagtaaaaggctggacctggtgaaggagaagaccatcaaccagaccattggtggtgtggtctaccatgctgctgacctgcccatctggtggcagatcccacagtatgtgctcattggcatcagtgagatatttgcaagtatagcaggtctggagtttgcgtactcggctgcccccaagtccatgcagagtgccatcatgggactcttcttcttcttctctggcattgggtccttcgtgggctcaggactgctggccctggtgtctctcaaggccatcgggtggatgagcagtcatacagactttgggaacatcaacagctgccacctgcattactacttcttcctgctggccgccatccagggagctacgctgctgctcttcctcattgtgtctgtgaagtacgaccgccagcgagccaggacagatggggggacagccagcacgaggacctgatgcagccagccagcatgctcacaggttctgcagactataaggcctcagggcttgctaactaccagggcactgccagcaagcaggttgaggctagatggttggtgtcccaacttctgaacttgcatgttgtctggactggcttctccctccctgtgcccagatgatggtggtgagtgccttactgtggcccgtctcatgtgcactgggcctaccaggagatgagaatgtggcttctctcactgaaggtctctgcccgttctgagccagccatgctttctcttttagaatcctgagcagcccctgtcctgctgctgggcatccttattccttacaaacactgttactttcatagcatctcctgtaagattagcaagcatttccatcaagcggtaggaggattctcttcagagatcaaagtgtggttgatggcgagagagccccatgagctgtttctgctccattgatggtctcttgtcacagatcttgctgatgccaaggcctttgtgggtcagtagtgtagactcatctgctcaaaaagtagttttgttggctaaggtgaagaagtgtttcttattacactaggctggcctcactaggctgacctcaaacttggtgctgcctcctgtctgcttctcaagtgctaagatctcagatgtccatcaccatggtcagcaggacttaggtcatgaactactgatctgctttaagcacatgcatcagtggtgagtgaggacaccatgttctcactgagaccagacagcagctggcaggagattggcatttacacctggcagatcttttctgagaacttgactttgtgtagcagtaagattggaggcaggtggtgagtggggaaaacacgggagctgttgggctggtcgcccacctttgtattgttactgacatatctggggttctgagtgtgtcaactaaaccattttatgtgttgctgtgtcttgtataatttgataaaagcttctcagacatg

SEQ ID NO: 49 - DNA, 2118 bp, Rattus norvegicus
aggatgagcagtgactactcgtacaccgctaggatgttgggcaaaggggcactgatgacactaccaaggtgaaaccagccctcctggccatgggaggagctgtggtggacgagggtcccaccggcatcaaggcccccgatgggggctggggctgggccgtcctctttggctgtttcatcatcacgggcttctcctatgccttccccaaagcggtcagtgtttttttcaaggagctcatgcatgagtttgggattggctacagcgacacagcttggatctcctccatcctgctggctatgctgtatggcacaggcccactctgcagtatgtgtgtgaaccgctttggctgccggcccgtcatgcttgtgggtggcctctttgcgtccctggggatggtggctgcatccttctgcagaagcattatccagatctacctcaccacaggggtcatcactggcttgggtctggctctcaacttccagccctccctcatcatgctcaatcgatacttcaacaagcgccgccctatggccaatgggctggcagcagcaggcagtcccgtgttcctttgtgcactgtctccactggggcagctgctgcaggaccactatggctggcggggtggcttcctcatcctgggaggcctgctgctcaactgctgcgtgtgtgctgcactcatgagaccactggtagcaccccaggcgagtggaggggctgagccccatggaccccagcggccgtctccgcgcctgctagacctgagtgtcttccgagaccgtggcttcctcatctatgctgtggctgcctcaatcatggtgctggggctctttgtgcctccggtctttgtggtgagctatgctaaggatatgggtgtgcctgacacaaaggctgccttccttctcaccatcctgggcttcatcgacatctttgccaggcccacggcaggtttcataacagggctcaagaaggtgcggccctactctgtctacctcttcagctttgccatgttcttcaatggcttcactgacctgacaggctccacggccagtgactacggtggcctggtggtcttttgcatcttctttgggatctcgtatggcatggtgggagcgctacagtttgaggtgctcatggctatcgtgggcactcaaaagttctccagtgccattggtctcgtgctgctgttagaggctgtggctgtgctcatcggacccccatcaggaggcaagctgctggacgcaacgaaagtttacaagtatgtgttcatcctggcgggggctgaggtgctcacctcctcccttgtgctgctgctgggcaacttcttctgcatcgggaagaggaagaggcccgaggtgacaaagcctgaggaggtggcctcagaggaggagaagctccacaagccccctgtggacgtgagggtggactcgagggaggtggagcacttcctgaaggcagagcctgagaaaaacggggaggtggttcataccccggaaaccagcgtgtgagcggcctggccgggcgggcagggagcagggaagaggtccagagactggcaacgctcatatttatttcacaaacaggaccagctgaggcggggccatcggctcagctcttggctgcctggtcagcgggtcagtgttttgcggggagaggtggcggggtgggaaccgcgtcattccaaagtggatctgcggtgaagccaaggaagccccacagttaccagccgcctataaccagggacccagcctgctgagcccaagcagcctgtggctcccccgcccccaccactgtggccaaggacctagaaacccacacttaggagacaacacgactttaatcagagggcagggctgggacaggctggcaggtgggcactgcctgcagggtcctccctgatccccaccatcctacccccaacttcagccccagtctcctatattgccaatcctccatatctctgtctaggggacaaagaactccttctacctgagaaggcagagatagacatctctgtgggaggatcaccaaagggcctgtctctaggagctgtgtggtttctgggcagtggtctgttcaccctgagtcccacctttgttaaataacaaactcctgattctt

SEQ ID NO: 50 - DNA, 588 bp, Rattus rattus
gatatggaagaggaaagggtgatcccgactgagaagggccggctcctagcagagcaacttgggtttgacttctttgaagccagtgccaaggagaacatcagtgtgaggcaggccttcgagcgtctggtggacgccatctgcgataagatgtctgactcaatggacacagacccctccgtgctgggcgcctccaagaccacacggctctcggacaccccgccgctgctccagcagaactgctcttgctaggcaaggcccgccctgctgttccccccatgtcatgcccacttctcctctgcttctctctgttactgtctgctccccgaaccccaagccagctgagttctttgccagcccctgtggttctctgcagatggccccagctacagatactaactgcaggttactgtgtgggtgaagactcctcttacaacagaagactccctcttaggaaggaggttcaacatagagacttggaaagaaccttttctgcccttaaaataaaattcccttcatttaccaagatacaactcccacacgcactccttaggggttgaccagtgtgtaaagtgaggcccagctgcacag

SEQ ID NO: 51 - DNA, 1981 bp, Rattus norvegicus
caacgcggttctgttggtgttcaggttccctactgacttcccttccagtggcagcggcggaggcggcagtggcagcggcaagcactgagcacgtttgggtagttgtccaagatgccgaatatcaaaatcttcagcgggagctcccaccaggacttatcccagaaaattgctgaccgcctgggcctggagctaggcaaggtggtgactaagaaattcagcaaccaggagacctgtgtggaaattggggagagtgttcgtggagaggatgtctacattgttcagagtggctgcggtgagataaatgacaatctaatggagcttttgatcatgatcaatgcttgcaagatcgcttctgccagccgggttactgcggtcatcccatgcttcccttatgcccggcaggataagaaggataagagccgggctccaatctcagctaagcttgttgcaaatatgctatctgtagcaggtgcggatcatattatcaccatggatctacatgcatctcagattcagggcttctttgatatcccagtggacaatttatacgcagagccagctgtcctgaagtggattcgggagaacatatctgagtggagaaactgtactattgtctcacctgacgctggcggagccaagagagtgacctccattgcagaccgattgaatgtggattttgctttgattcacaaagaacggaagaaggccaatgaagtggaccgcatggtactagtaggagatgtgaaggatcgtgtggctatacttgtggatgacatggctgacacttgtggtacaatttgtcatgctgctgacaaacttctctcagctggagctaccagagtttatgccattttgacgcatgggatcttttctggtccagccatttctcgcatcaacaatgcatgctttgaagcagtagtagttaccaataccatacctcaggaggacaagatgaaacactgctccaaaatccaggtgatcgacatctctatgatccttgcagaagccatcaggagaacccacaatggagaatctgtctcctacctgttcagccatgttcctctataatatcataaattctgaagcgttttcaaaatgaaaccacccccaccccttgtttttcttgtatttggtgagttgggcagaagagccagcttgcttcagtgtagctttttacagcccacattagctacattaggatttatcctaattggagaaagacagactgctattaactgctaggacaccctacgtgcattgttgcagcctggctttcttgtttattttgtgatccttgcagctttaaattgagttccactgttgaaagctgcatagactgttaaaagagagagtattccccaaggtccttaggatggaattgtggagctcatactccattgcatgtgaaggctttggagtttccttcattcagaataactagcgacaaagccagccctcgtgtgatacattttcagaggtgtatgctacactgcagcaagttccctgtgcatccttaaacagagttcgcctgctgagcaccctgtacggcaggggcgggtagctcaatgcagtaatcaatttttgggaggaagaagcctgatctattatcatctgtttaattctctgtagcttggattctctatgcctattcctttcctgttggcttcaccttcagctatctcgaccctttcctggacaaatatcttgaactcagtgatcattgtttgtgacaaaattttctgtaagacagacttgcttcttgctatgtaactgctaacgttgacattaggtaacttgctatagcacaatcttccttagcccgctctctctgagttagtgggttttaggtggtgtgtgtgtcgtagtgccttttgattaatttaagtatttaatttttatcttccttcgatctgtttggcttaacaatttgatcttattgtctcatgtagaagaaacttaataaaatgtctgtcatgtgtac

SEQ ID NO: 52 - DNA, 1257 bp, Rattus norvegicus
cacgaagccggagccccagacgcgcacaggccgccgcagcagctccggtgttcagcaggatgtcccggtggctaatgcaaatgttgatgctgcccctattgctgctccctttgggtcaagctgcccccaaggatggagttgcaaggctggaccctgaggcacaacagcagctcacaaccaaccccttccagccaggccctgagcagctccgacgtctgcgggattatctcaagggactggagaagatggaagaggaccctgaacaaatgaaccgggagcaagtcctgctatatctctttgctcttcacgactttgaccagaacggacaactggacggcctggaactcttgtccatgctgacagcagctctggcccctggagctgcacacttccccatcaacccggtgatcctggtagtagacatggtgcttgagactcaggacctggatggagacgggctcatgactcctgcagagctcatcaacttcccaggagaagcccccaagcgcgcagagtcccttcccccagctctccaggagccacaacctgccggaagtcagccgcttttagccaacagtccgctgcaatcagaaacccagcaatccctggggactaaagaagaaattacaagtcaggtagaggccaaaagggccttggagcctgaacaggaggctggacatcacatagagactaaagtagatgctctaagccctgaaggggaggctaggggtcaggcagagtctgaaggagatgccccaggtccccgagaggatgctgagagacaggtggagagcaaggacaacgaaggggaagccaaagacctgccagcggaaacactagagacccaaaacactccaaatgtggttgaggctcatagcatccaactggaaaacgacgagatatgagctagacacacaggctcatgcccctcaggatctcagtgcagaacagaagcatcaagtgtgaatacagtgggtctggagccacctctgacatgggtatggtggtccaagctcgtactcccagaagcactgagagctccaggctagcctaggccacttagcaagtttgaagccaggctgggctacttcgtgaggccctgtcttgaggaggggaaaagaaacgctctcccacgtctcctttctggccctcagtaggaagcaggacttttcttcgcagctcaggggagaccacaagctgagaggcagatttcaggccccaaacaatcaataaaaaacaaaatggatttgtctccat

SEQ ID NO: 53 - DNA, 811 bp, Rattus norvegicus
gccttttctctgccttgcttgcttgagctccagcacagtccgagatggctggcggtaaggctggaaaggactccggaaaggccaagacaaaggcggtttcccgctcccagcgagcgggcttgcagttccctgtgggccgtattcatcgacacctgaaatctaggacaacaagccacggacgtgtgggcgcgaccgcagctgtgtacagcgcagccatcctggagtacctcaccgcagaggtacttgagttggcaggaaatgcatcaaaagacttgaaggtaaagcgtattacccctcgtcacttgcaacttgctatccgcggagatgaagagttggactctctgatcaaggctacgattgctggtggtggtgtcatcccacacatccacaaatcactgattgggaagaaaggacaacagaagactgtctaaggatgcctggattccttgttatctcaggactctaaatactcttaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgaatctgaagtggtgggttttgattgagttgactgtttttaaaaaactgtttggattttaattgtgatgcagaagttatagtaacaaacatttggttttgtacagacattatttccactctggtggataagctcaataaaggtcagatcccaaactaaaa

SEQ ID NO: 54 - DNA, 1050 bp, Rattus norvegicus
atggaaatatacacttcggataactactccgaagaagtagggtctggagactatgactccaacaaggaaccctgcttccgggatgaaaacgaaaacttcaacaggatcttcctgcccaccatctattttatcatcttcttgactggcatagtgggcaatgggttggtaatcctggtcatgggttaccagaagaagctgaggagcatgacagacaagtaccggctgcacctgtccgtggctgacctcctctttgtcatcacactccccttctgggcagtggacgccatggctgactggtactttgggaaatttttatgtaaggctgtgcatatcatctacaccgtcaacctttacagcagtgttctcatcctggccttcatcagcctggaccgctaccttgccattgtccacgccaccaacagccagagcgcgaggaagctgctggctgaaaaggccgtctatgtgggtgtctggatccccgccctcctcctgactatccctgacatcatcttcgccgatgtcagccagggggacggcaggtacatctgtgaccgcctttaccccgacagcctgtggatggtggtgttccagttccagcacatcatggtgggtctcatcctgccgggcatcgtcatcctgtcctgttactgcatcatcatctccaagctgtcacactccaagggccaccagaagcgcaaggccctcaagactacggtcatccttatcctggctttctttgcctgctggctaccgtattacgtggggatcagcatcgattccttcatccttttggaggtcatcaagcaaggatgtgagttcgagagcgtcgtgcacaagtggatctccatcacggaggccctcgccttcttccactgttgcctgaaccccatcctctacgccttcctcggggccaaattcaagagctccgcgcagcatgcactcaattccatgagcagaggctccagcctcaagatcctttccaaagggaaacggggtggacactcttccgtctccacagagtcagaatcctcaagttttcactccagctaa

SEQ ID NO: 55 - DNA, 540 bp, Rattus norvegicus
tttttttttttttttttgcttttcagttgctttattgactttacattttttccatgcaaatgggcaacactgtactgttgacagaaactcacactgagtgggaaggcaatttccaattataagttggcaacacaagccccgcctggcacatggaaataacacaaggctcaccacaaacgggtcatttaaaggcatgtcaggaaaatgcaagggctaggaatacagcgggaatcacagtatgaatctcaggggaaatgaccgaagtcaaggcataaggcagaattcatcgtgatggtcgtggtgattagagagctcccccataagaatacgcagacaatttctcaactgcagctccctaagctttctccggatctctctcatctcctccatgaacatttccatatcatctccatctccacccaacccatcattcatctgcctgttgggaatggcccatcgaaagttaggggcaagtcggcgggcctgtcctctccggtgatgattgtggttgtggttgtggttgtggttgtggttatggtt

SEQ ID NO: 56 - DNA, 583 bp, Rattus rattus
accagaaaataaagccgttttattattttcgtcttatccaccatatggcctgagggttggggtgggagcagagtaaatggctggccccagatgaaggctctggagtcttctacttggcctgaacagtctcctccagcctgtccaggcgctcttgaagcttttgcactatggcgttgagattcctcacatcctcctccagccgtgacacggtgtccgagctaagagtgctactgggctccggtgtagctcttctgcgagcactgtccaggcccctgttgactcttagctccctgctctttgggggcacgtagccatccttgagggaaatgaggagggggccagcatcacgaccgctcagccactcctcagctgtgagggcggggtcgggtccggcagtgggtggatacaggtcctcctggaacaggtccgactttctaggcactgtcatggcaataggctcacatttccgctcatgaagcttatagaatctggcaatctcgcacttattcacttccaggccacgtttgggcatgtagcccataccacgttgagactccttggaactgaacatggaaagataatg

SEQ ID NO: 57 - DNA, 416 bp, Rattus rattus
acaaacaaaaataaatcccagagataatgaaataaacatattctctaaagtatcccatgctggtttctctgtccgagaatgtggtagagtccatgtttaagttcctggaacattcctggatgctatgaagtctccatcttgtaaccatgcttctccagctcagcgcgtaactgattggagaagtcgtcttctacattgtcatcatcccaattatcctcccagacatgtgcatcttcatcttcatctaagccggcccagtcttccgcgggaaactcctcgaactcgtcgtcctcttcaccacattctggataacaacaaaggaaacaacaggtcacatatcttacggaccatttcctcaccatcaaaaacatctggattcccctcagccagttacaggctagatgctcttgctgttt

SEQ ID NO: 58 - DNA, 1259 bp, Rattus norvegicus
ggcacgagggcgagggtgcagccccggagcggcggcggggcaaaatgaaaaacgaaattgctgctgttgtcttctttttcacaaggctggttcgaaagcatgataagttgaaaaaagaagcagttgagaggtttgctgagaaattgactcaaatacttcaagagaaatacaaaaatcactggtatccagaaaaaccctcaaaaggacaagcctacagatgcattcgtgtcaataagtttcagagagttgatcccgacgtcctgaaagcctgtgaggacagctgcatcctgtacagtgacctgggcttgccaaaggagcttacactctgggtggatccgtgtgaggtgtgctgccggtatggaaagaaaaacaatgcattcattgttgccagctttgaaaatgaggatgagaacaaggatgagatctccaagaaagttagcagggctcttgataaggtgacctctgattatcattcagggtcctcctcctcagatgaagacacaagcaaggaagtagaagtgaaaccgagtgcagtggctacaacgccaagccccgtgtaccagatttcagaactgatattcccacctcttccaatgtggcaccctttgcccagaaaaaagccaggaatgtaccgagggggtggccatcagagtcactaccctcctcctgttccatttgcttatccaagtccaggaaggaagaataaagcgttccgcccaattccagtgacatgggtacctcctcctggaatgcattgtgatcggaatcactggattaatcctcacatgttagcacctcactagttcatttggattgggcggatgtcattttgatagaaaggaagaaataccttcttagatacttaagagtttcacaacttgtagtgaagtcagatggacaaaaccatcaggcttatttttatagaaaagctattgagataatctttcttaaagtatatatatatatgcactttagatatattgatatagtttgagaaactttattaaagttagtcaagtgcctgagtttttaatattggacttgagtatttatatattgtgcattgactctgttggatacaaaacactgtaggagggcgatatgttttagcacctttgagcatttactttatggagaatatgtaagttatttatacagaaggacatttattttatgtcacatagaagaattgtgtgaaatcatgtagttgcaaataaaaagtagtttgaggcgtgaaaaaaaaaaaaaaaaaaaaaaaa

SEQ ID NO: 59 - DNA, 877 bp, Rattus norvegicus
gaattcggcacgagggtcgtccgcgtgtccggctcttgcccacgcagtcatggcctccggcaacgcgcacatcggaaagcctgcccctgacttcacgggcaccgccgtggtggatggtgcctttaaggaaatcaagctttcagactacagagggaagtacgtggtcctctttttctatccactggacttcacttttgtttgccccacggagatcatcgcttttagcgaccacgctgaggacttccgaaagctaggctgcgaggtgctgggagtgtctgtggactctcagttcacccacctggcctggatcaataccccacggaaggagggaggcttgggcccactgaatatccctctgcttgctgatgtgactaaaagcttgtcccagaattacggcgtgttgaaaaatgatgagggcatcgcttacaggggcctctttatcatcgatgccaagggtgtccttcgccagatcacagtcaacgacctacctgtgggacgctctgtagatgaggctctccgcctcgtccaggcctttcagtatacagatgagcatggggaagtctgtcctgctggctggaagcccggcagtgacaccatcaaacccaatgtggatgacagcaaggaatacttctccaaacacaactgagatgggtaaacatcggtgagcctgaatcccggatctcacctgcgcccttacctggatgtcctgtgctggcccagaaaacgctagatcttcctctacattctaaaggggctggaggctaggccgaggctttctcattacccacctggaatctggtgaatagtgaccctgccctgagcacacccagctgggcccaggtctataggaaaccaataaagtattagggacagtgta

SEQ ID NO: 60 - DNA, 601 bp, Rattus rattus
ataccaaagaaaagtctttattgtaaacaaggtataaagtacaacaaaaaatattgtgcaaattgtaactcgtgattttttttataatttttaagaaaactctttttttcaagggttcaagtttgcatgtcagaaacctatgagatacagaaacggtttaaatgggaaggtatggtgagtttttcactgtggactttgaataatttacctttactaccaagtgtgtcttctatccactttacaacagaacagaaatactgttagcaaaagtcactgctttcaggtggggatacaactcggtgacagagcttacagaacacaagcaaggctctggatccccagaactgcaggtgtgaccacattatgacactttaaagtctcggagtttcccggacacccagacactgcagcggcaggaagaacgtatctgcaccatgaatatccttgtcaagtcggaagtgaatgttctagtaacaatttcctacctatctactcagacatcctgacaaactcctataaataaaaggacacctgtccatctgtgatggtcactaacttcctgatttgatagaaacagtgtacgtctgacgtaagtgtcctt

SEQ ID NO: 61 - DNA, 441 bp, Rattus norvegicus
tttttttttctttttttaaagctcattttaaagtttatttatggtggggttggatacatgttttgcaaagtgtgctaactgcttaaactgaaaacagtccaattcaaatcagtccattccacatggatgtttcctgtgccaattggagtcatatggaaagggaccctgacctttctcttggtcaggtctgtgttgttgttaactcctgctaactctccagggccttccttgtcgatacggaccatcagtcccattcaaagaacaacatacagaacacctcaatgtatttcacaagtttagcacagcacatctcttgtacaaaaatccaagaaagcacagaagtgaaagtaccaacttgctcacttataaaacacacatgcatcaattttaaacactacacgagtacacaactgaatacattgcattacaagataaaaaaag

SEQ ID NO: 62 - DNA, 2175 bp, Rattus norvegicus
gcagaaatgcttcgactacccacagtccttcgccagatgagaccagtgtctcgggcactggctcctcatctcactcgggcctatgccaaagatgtaaaatttggtgcggatgctcgagccttaatgcttcaaggtgtagaccttttagccgatgctgtagctgttacaatggggccaaagggaagaacagtgattattgaacagagttggggaagtcccaaagtaacaaaagatggggtcactgttgcaaagtcaattgatttaaaggataaatacaaaaatatcggagctaagcttgttcaggatgttgccaataacacaaatgaagaggctggggatggcaccaccactgccactgttctggcacggtctattgccaaggagggctttgagaagatcagcaaaggggctaatccagtggaaatccggagaggtgtgatgttggctgttgatgctgtaattgctgaacttaagaaacaatctaaacctgtgacaacccctgaagaaattgctcaggttgctacaatttctgcaaacggagacaaagacattgggaacatcatttctgatgcaatgaagaaggttggaagaaagggtgtcatcacagtgaaggatggaaaaaccctgaatgatgagctagaaattattgaaggcatgaagtttgatagaggatatatttccccatattttattaacacatcaaaaggtcaaaaatgtgaattccaagatgcctatgttttgttgagtgaaaagaaaatttctagtgttcagtccattgtacctgctcttgaaattgccaatgctcaccggaagcccttggtcataattgctgaagatgttgatggagaagctcttagcacactggttttgaacaggctaaaagttggtcttcaggttgtagcagtcaaagctccagggtttggggacaacaggaagaaccagcttaaagatatggctatcgctactggtggtgcggtgtttggagaagagggtttgaatctaaatcttgaagatgttcaagctcatgatttagggaaagttggagaggtcatcgtcaccaaagatgatgccatgcttttgaaaggaaaaggtgacaaagctcacattgaaaaacgtattcaagaaatcactgagcagctagacatcaccactagtgaatatgagaaggaaaagctgaacgagcgacttgctaaactctcagatggagtagccgtgttgaaggttggagggacaagtgatgttgaagtgaatgagaagaaagacagagttacagatgctctcaatgctacaagagcagctgttgaagaaggcattgttctaggagggggctgtgctctacttcggtgcatcccagccttggattcattaaagcctgctaatgaagatcagaagataggtatagaaattattaaaagagcacttaaaattcctgcaatgacgattgctaagaatgcaggtgttgaaggatctttgatagttgaaaaaattctgcagagttcctcagaggttggctatgatgccatgcttggagattttgtgaacatggtggaaaagggaatcattgatccaacaaaggttgtaagaactgctttactggatgctgctggggtggcccccctgctaactacagccgaagctgtagtgacagaaattcctaaagaagagaaggaccctggaatgggtgcaatgggtggaatgggagggggtatgggaggtggcatgttctaactcctagaatagtgctttgcccttatcaatgaactgtggcaggaagctcaaggcaggttcctcaccaataacttcagagaagtcacctgaagaaaatgactgaagagaaggctggctgatcactgtaaccatcagttactggtttcctttgacaatacataatggtttactgctgtcattgtccatgcctacagataatttattttgtatttttgaataaagacatttgtacattcctgatgctgggtgcaagagccagtgtcctgctttcaacttaaatcactgaggcatctctactgttctgttagcatcaggactgtagcgctgtgtcaccacatgagaagttcagaagcagcctttctgtggagggtgagaatgattgtgtacagagtagagaagtatccaattatgtgacaacctttgtgtaataaaattttgtttaaagtt

SEQ ID NO: 63 - DNA, 549 bp, Rattus norvegicus
tttttttttttttttacaagagtgcagaagagagagagaaactagtaaaggctgaaagaaaattcattgaagatagagttaaaaaaatcgtagaactgaagaagaaagtctgtggtgattcagataaaggatttgtcgttattaatcaaaaggggattgaccccttctctttagatgccctcgcgaaagaaggcatcgtagctctgcgcagagccaagaggagaaacatggagaggctgactcttgcttgtggtgggatagctctgaactcctttgatgacctgaatcctgactgtttgggacatgcagggcttgtctatgagtatacattgggtgaggagaagttcacctttattgagaaatgtaacaatccccgttctgtcactttactggttaaaggaccaaacaagcacacgctgactcagattaaggatgcaatcagagatggcttgagggctgtcaaaaatgctattgatgatggctgtgttgtcccgggtgcaggtgcagttgaagtggcactggcagaggctctgattaaatacaagccca

SEQ ID NO: 64 - DNA, 792 bp, Rattus rattus
cgcgtacccgggaagtccccgtgtgtgtgtaccttgcagcctcccgcttcccggaaccatggagtacctcattggcatccagggtcctgactatgtcctggtcgcttctgatcgggtggccgccagcaatattgtccagatgaaggacgatcatgacaagatgtttaagatgagtgaaaaaatcttactcctatgtgttggagaggctggagacactgtacagtttgcagaatatatccagaaaaacgtgcagctttataaaatgcggaatggatatgaattgtcccccacagcagcagctaatttcacacgccgaaacctggccgactgtcttcggagtcggaccccttatcatgtgaacctcctcctggctggctatgacgagcatgaggggccagcactttactacatggactacctagcagccttggccaaggctccttttgcagctcatggctatggtgccttcctgaccctcagcatccttgaccgatactacacaccaactatctcacgtgagagggcagtggagcttcttaggaagtgtctggaggagctccagaagcgcttcatcttgaatctgcccaccttcagcgttcgggtcattgacaaagatggcatccacaatctggagaacattaccttcactaagcggagttcctaacatcatgttcttccctcccacttaccagggacctttttttgatgggttccttttatttttttctactcttttgacgttcactctcaatagatggttaattcaaaataaagctgaacacagctaaattg

SEQ ID NO: 65 - DNA, 1610 bp, Rattus norvegicus
ggccgggcggaactttccagaacgctcggtgggtggtagaggagcagcgtctggccgagctgcgctgtgctacgctcctctttccgctctccggcgccggcccgctcaccggctgtaaaaaatggtgaaagaaactacttactatgatgttctgggggtcaaacccaatgccacccaggaagaattgaaaaaggcatatagaaaattggccttgaagtaccaccctgataaaaatccaaatgaaggagaaaagtttaaacagatttctcaagcttatgaagttcttgctgattccaagaaaagggaactatatgataaagggggcgagcaggcgattaaggagggcggagcaggtggaggttttggctcgcccatggatatctttgatatgttctttggaggaggaggaaggatgcaaagagaaaggagaggtaaaaatgtcgtgcatcagctctcagtgaccttagaagacttatataatggtgcaacaaggaaactggctctgcaaaaaaatgtgatttgtgacaaatgtgaaggccgaggtggtaagaaaggagcagtagagtgctgtcccaactgccgggggactggcatgcagatcaggattcatcagattggaccaggaatggttcagcaaattcagtcagtgtgcatggagtgccagggtcatggagaacgcatcagtcctaaagacagatgtaaaagctgcaatggaagaaagatagttcgagagaagaaaattttagaagttcatattgataaaggcatgaaagatggtcagaagataacattccacggtgaaggagaccaagaaccaggactggagccaggagatattatcattgtgttagatcagaaggaccatgctgtttttacaaggcgaggagaagaccttttcatgtgtatggacatacagctggttgaagcattgtgtggcttccaaaagccaatatctactcttgacaaccgaaccatagtcatcacctctcatccaggtcagattgtcaagcatggggatataaaatgtgtgctaaatgaaggtatgccaatataccgtcggccatatgaaaagggacgtctaatcattgagtttaaggtaaactttcctgaaaatggctttctctctcctgataaactctctttgctggaaaaactccttcctgaaaggaaggaagtagaagagactgatgaaatggatcaggtagaactggtggactttgatccaaatcaggaaagacggcgtcattataatggagaagcgtatgaggatgatgagcatcaccccagaggtggcgttcagtgtcagacctcttaatgggccagtcactctttgaccttgtgtatgcagtagtgaatgtgggaaggactgtaatcataatatgctcactacttggctgttgtttttgttttaatattcaactatagtagtgttttaaaagttaaatgaagaataaacacaaatataaaagctctgactttgccctgtatgtatgatgactttaatgttcaagatgaaaatgaatacttgtaaaaaactagtttaaaaaatgccctagcatctgttaggccatatcttgtgtaactgataatagcgtgtacattagactgac

SEQ ID NO: 66 - DNA, 1130 bp, Rattus norvegicus
gtggagcggctgccagccggggaacaggcgcggccgcggcgccatattgcggccctcagcggtcgccaccgagccatggctgagacctacgacttcctcttcaaattcctggtgattggcagtgccggaactggcaaatcatgtctcctccatcagtttattgagaataagttcaaacaggactccaaccacactattggcgtggagtttggatccagggttgtcaacgttggggggaagactgtgaagctacagatttgggatactgctggccaggagcggtttcggtcggtgacacggagttattaccgaggggcagctggagccctgctggtgtatgacatcaccagccgggagacatacaactcgctagctgcttggctgaccgatgcccggacgctggccagccccaacatcgtggtcatcctctgtggcaacaagaaggacctggatcctgagcgtgaggtcactttcctagaggcttcccgctttgctcaggagaatgagctgatgttcctggagaccagcgctctcacgggtgaaaacgtggaagaagctttcctgaagtgcgcacgcaccatcctcaacaagatcgactcaggtgaactagatccggagaggatgggctcaggcattcagtatggtgacatatctcttcgccagctgcggcagcctcgcagtgcccaggccgtggcccctcagccctgtggctgctgagacgtgcagagccagctcacctgttcttctggaccagccctgctcgaaggctggggctcagaaccaggccccaagaggccaggccccaatctgccccagtcccagaaaagttactccatcacccatccccctcccctggcctgctggggcctggctttggggcaagattgagccacaggggaaaggggaccccatacctgctgctgcttcctctgtcttggctaactctagtccccctccccgagcccctaaccatacctgaagaactcccaaagcttgagaccagggccaattggccccaacgtcctgcctggccccgctgttgcaagtctgtgttatttattacctggaggcctgttccatcctgtcccagtcctccataaagcattgtttacacctgtgaaaaaaaaaaa

SEQ ID NO: 67 - DNA, 853 bp, Rattus norvegicus
ggccacgcgtcgactagtacggggggggggggggaatgaggcggaccatctgaccccgctcgctcgctccacgcgctggcacgggagcgacagccaactgcagagcgaattcctctcacgccagtcactcagagcaatgaaactgtaacagttgttttcccaaatactgtacgatggtacgactgaccagcaacttccttttgttttgtattatatatatctttaaaatatcttgtcagttttactatgtatgttcatccattcaccaaagccctcaaaaagaagtttctccacagaacaggcacctcaggctctgtcccaaggaatgtgttttaatttttgcccggataaaagaaaataagctttgcacacactctcgattctttatttgcaggcaaacttcactctttattatctgaaacttttccattctcagcctcttagaggcacagatggctcaagtttcagtggcaaaaaagtctttttttttttttctttctgtaaccaaactagagcaaatttggaattcagtctgggactaaaacgtcacagcagaaaaaaaatgaaaaaaaaataatttgctttttctttctttcatttagcagcataaataagtttggccactgggagtacagtacaggggttgggacaacgatcccgtatttgaagacctacttctagcaccagcatcaagaactaaatccacctcaggactcacagaacccaggacaacttgccatctttgagcaacatatgcattgaagagtgtatatagaagcaacagtaaatagattaacagaggctaatactgtgattgattgacattggcaatggttggcaaaaaaaaaaaaaa

SEQ ID NO: 68 - DNA, 409 bp, Rattus rattus
aaaaacaatccattttattaggttttaaaactagttacacaattgaaagtcaattaggtactactctgtacagggactgtgcctgggtatgctcacacttcaatactgtactaagcccactgtgtagattgagacattcagcatgtagatactaaaaaataaactgtagtattcctttaaggaagattgtaaagggtgtgtcacaagatgacattcatcaactttgaattattccaactagaagatattttacactctaaagttgtgacaggcaaacatgttacttaaaaatgcacacaaaaaggtacataaaaatccagatattctaatgataaatgaacttaaaaaaccacctatgtttcagcttttgtaacatgagaagataaagaatataatttaaaaacacaca

SEQ ID NO: 69 - DNA, 759 bp, Rattus norvegicus
cctcaggctcagacacctgctctactccaagcaaatggctgctcttccaatgctgtggaccgggctggtcctcttgggtctcttgggatttccacagaccccagcccagggccatgacacagtgcagcccaactttcaacaagacaagttcctggggcgctggtacagcgcgggcctcgcctccaattcaagctggttccgggagaagaaagagctactgtttatgtgccagacagtggtagctccctccacagaaggcggcctcaacctcacctctaccttcctaaggaaaaaccagtgtgagaccaaggtgatggtactgcagccggcaggggttcccggacagtacacctacaacagcccccactggggcagcttccactccctctcagtggtagaaaccgactacgatgagtacgcgttcctgttcagcaagggcaccaagggcccaggccaggacttccgcatggccaccctctacagcagagcccagcttctgaaggaggaactgaaggagaaattcatcacctttagcaaggaccagggcctcacagaggaggacattgttttcctgccccaaccggataagtgcattcaagagtaaacacaggtgagagaagtcagtcacaggtaacacatggtgatgtggcctcaggactcccgtgctctgtcactcttgagacccaagccctggctccccaaagaccttctccgccctccagctttgccttggtggagaaataaaatccaaagcaagtc

SEQ ID NO: 70 - DNA, 1136 bp, Rattus norvegicus
gggcttcttggacgtttttgggaggggacagcaagggaaggtccttctgcctctagggacccagacttccgctttctgcagacagcagcaggctctgggctctgggaatccactgctgtctggcctagaagcatcatagaacacgaggattccatacacaggaggcccctgaagctgagctgagctgatgaagacacagtggagtgagatcttgacacccctgttgctgctgctcctgggtttgctccatgtctcctgggcccaaagcagctgtactgggtcccctggcatccctggggtccctggcatccctggggtccctggctctgatggcaaaccaggcactccagggataaaaggagagaaagggctccccggactggctggagaccatggtgagttaggagagaaaggggatgcagggatccctgggatcccaggcaaagttggccccaagggtcccgtcggccctaagggtgctccaggcccccctggaccccgcggtcccaaaggtggctctggagactacaaggctacccagaaagtagccttctctgccctgaggacggtcaacagcgccctgcgaccaaaccaggccattcgcttcgaaaaggtgatcaccaatgttaatgataactacgagccgcgcagtggcaagttcacctgcaaggtacctggcctctactacttcacctaccacgccagttcccgcgggaatctgtgtgtgaacatcgtgcgcggccgcgaccgagaccgcatgcagaaagttctcaccttctgcgactatgcccaaaacaccttccaggtcaccacgggtggggtagtcttgaagctggagcaggaagaggttgttcacctgcaggccacagacaagaactccctgctgggcgtcgagggagccaatagcatcttcactggctttctgcttttccctgacatggatgtatgatcacggggtcaaatcactcctatccaaaacctcctccctgccagtaatcctccctggaccccagacactgccctttgactgcccaaagccctgaccagagccctgtagatgttacagaatgggtaaataaactcttcaaggccaagaaaaaaaaaaaaaaaaaaaaaaaaaaaaaaaaaaaaaaccc

SEQ ID NO: 71 - DNA, 883 bp, Rattus norvegicus
gctagctgtcctcctgggattcagtcatttaaagattgagaccaagattgaaagcatggctgacctcaagcagctcatggacaacgaggtgttgatggcctttacctcctatgcaacgatcattcttgccaagatgatgttcctgagctccgcgactgcattccagaggctaaccaacaaggtttttgccaacccggaagactgtgctggcttcggcaagggggagaatgccaagaagttccttcggactgacgagaaggtggaacgcgtgcgaagagcccacctgaatgaccttgaaaacatcgttccctttctcggtatcggcctcctgtactccctgagcggaccggatctctctacagccctcattcacttcagaatctttgtgggcgctcggatctaccacaccattgcttacttgactccccttcctcagccaaacaggggcttggcattttttgttggctacggagttactttgtcaatggcttacaggctgctcaggagcagactgtacttgtaaagagatttgtgaccgtcaccctctgattgatttaaaaaaataaaggattctatatttctagtgtattaaaaaactttctaaggttttatgtatgaaaggagcagagaaatcaggaatcagggaaaattctgtttgaagactaccatccacaggctctacccttttgtacctgggttagacatttaacatgaccggccttagctatgctgtctaactcctaaagtactttgtcctaagtcttgagtgccttataaattgtaacattccttctacatttcctgtggtgcatctataaaagagtgctcacacctgtgtgaagcctgggtttcattggcacctgaattaaaaacattacaaatg

SEQ ID NO: 72 - DNA, 1592 bp, Rattus norvegicus
gtcgaagcagcccgacggatttagccaggtccgggatctcagatgggggcaaaggcacctcaggcgctgctcctgctggtggcggtcgccctggccccgacccagacccgcgcaggctcacactcgctgcggtatttcgaaaccgccgtgtcccggcccggcctcggggagccacggttcatctctgtaggctacgtggacgacacggagttcgtgcgctacgacagtaacgcggagaatccgagatacgagccgcgggcgcggtggattgagtgggagaagccggactattgggagacgcagacacggagagccaagggaaacgagcagatttaccgagggagcctgacgaccctgctccactactacaaccagagcgaggacggctctcacaccatccagtggatgtatggctgtgacgtggggtcggacgggagcctcctccgcgggtattggcagcacgcctatgatggccgcgattacctcgccctgaatgaagacctgaaaacgtgggaggcctcggacagagcggcgcagaaaacccggaacaagtgggagcggaaaggtgttgcagagagaagcagggcctacctgaagggcacatgtgtggagtcgctccgcagatacctggagctcagaaaggagacgctgctgcgctcagatcccccaaaggtgcgtgtgacccttcaccccagacctgaaggtgatgtcaccctgaggtgctgggccctgggcttctaccctgctgacatcaccctgacctggcagttgaatggggaggacctgacccaggacatggaacttgtggagaccaggcctgcaggggatggaaccttccagaagtgggcatctgtggtggtgcctcttgggaaggagcagagttacacatgccttgtggagcatgaggggctgcctgagccgcttacccagagatgggagcctcctccatcaactgattccaacatgggaatcattgctgttctggctgtcgttggagctgtggctgtcattgtacttgtggccctcattggagttgttgtgaggaggaggaggaaaaacataggtggaatatgaggagattacgcccctgctctaggcagggacagctgccagagctctgatgtctctcccagattgtaaagcatgaagacagctgcctggagtggactgagtgacagatgatgtgttcaggtctctcttgtgacatccagagccctcagttctctttagacaccagtgtctgatgttccctgtgattctatggcttcagtgtgaagaactgtggagcccagcctgccctgcacttcaggaccctgtccctgcactgccttccttcccttcctaggccaaccttagtggtccagcctgggggtggggggtggggacatctacatcctgtccctccttgctgccctgagtgtcagcccctcacttccacactgagaataagaatctgagtgtgaacttgattgttcacatccttgactcaagtgtggatggctttttcaattactggatggaatacttagaggtttttcgttttggggttttgttttgaaaaaaaataaatggcagatggagaagcttggaaa

SEQ ID NO: 73 - DNA, 627 bp, Rattus norvegicus
gaggagccagccaacacactgcagcctcatcgtcatctccccacctaaggccaccagcgtctgaggagctatgagccagagcaaggatttgcagggaggaaaagcttttggactgctgaaagcccagcaggaagagaggttggatgggatcaacaagcacttcctcgatgatcccaagtacagcagtgatgaggatctgcagtccaaactggaggccttcaagacgaagtacatggagtttgatctgaatggcaatggagatatcgatattatgtccttgaagcgaatgctggagaaacttggggttcccaagacccatctagagctgaagaaattaattagagaggtgtccagtggctccgaggagacgttcagttactctgactttctcagaatgatgctgggcaagagatctgccatcttgagaatgattctgatgtatgaggagaaaaacaaagaacaccagaagccaactggtcccccagccaagaaagctatttctgagttgccctaattggaggtggatataacacggtgggaccgaggaccttctaatgacagcagcatgggaaaagaagaagcagttgtgagccagagtcaaactaaataaataatgctccctagtgc

SEQ ID NO: 74 - DNA, 805 bp, Rattus norvegicus
gtgattccagaggtgactgtactccccaaaagcccggtgaacctgggagagcccaacatcctcatctgtttcattgacaagttctcccctccagcggtcaatgtcacctggcttcggaacggacagcctgtcaccaaaggcgtgtcagagacagtgtttctcccaagggaggaccacctcttccgcaaattccactatctcaccttcctgccctccgtggaagattactatgactgtgaggtggatcactggggtctggaggagcctctgcggaagcactgggagtttgaagagaaaaccctcctcccagaaactaaagagaatgtcctgtgtgttctcgggttgtttgtgggtctggtaggcatcgtcgtcgggattgtgctcatcatcaagggccttcggaaacgcaacgcagtggaacgccaaggagccctgtgagataccgggaggtgatggcttccgtgagagctcatagaagaaatgtgctgtgacagcatctgaggctaccccttctctcagctcttcacctcagcagagacatcttctgcagtttccaacctcaagcctcgcgccagattctctggtctaatgtctggctggggttctccgtctgcttcctgtatctatattctattttccatcatttatagtaattcctctgtggcacatatcacagagctcttcctccgctgcggaactttctaagaatggaggcatcttctgttcacttacggcttgacatttctccaaactgtgttttctctttctctttttcaataaataataaacaccttgggtcctgaat

SEQ ID NO: 75 - DNA, 1150 bp, Rattus norvegicus
gcagcagcagcagcaccagcagcacttgggggaaaagctagaggctagagtcatggatgaccagcgcgacctcatctctaaccatgagcagctgcccatcctgggccagcgtgctagagccccagaaagcaattgcaaccgtggagtcctgtacaccagtgtctctgtcctggtggctctgctcttggctgggcaggccaccactgcttacttcctgtaccagcagcagggccgcctggacaagctgaccgtcacctcccagaacctgcaactggagaaccttcgcatgaagcttccgaaatctgccaaacctgtgagcccgatgcgcatggctactcccttgctgatgcgcccactgtccatggataacatgctccaagcgcccgtgaagaatgttaccaagtatggcaacatgacccaggaccacgtgatgcacctgcttacgaagtctggacccgtgaactacccacagctgaaggggagcttcccggagaatctgaagcaccttaagaactctatgaatggtctggactggaaggtctttgagagctggatgaaacagtggctgttgtttgaaatgagcaagaactccctggaggagaagcagcccacccagactccacctaaagagccactggacatggaagacccatcttctggcctgggagtgaccaagcaggatatgggccaaatgttcttgtgaagacagaagccagctctgcacggcggcacgtcccctgctcctcagcccttcttacactccctaacatcacacccattccgtcttcctgcacctgggcttgagactggtatctgcttcaccgtccctgacacaacaaatgaaaccggaacagaatgagaacactggagggagggccttgctgcctacccccatctaaaggacccccatttctgacccattagcagtctttaatgtggggctctgagatctaggcccactgacagggataggggatgccctacccttaatctaggctggatacatttgctgtcttctcaaggaagaggccaagccctcccagcaacccttcctcatgtcctgccgacgcccctgggatccctgctcagccaagcttgtcagcagcctgtaggaccatggttcacgtgacaataaaaggtagaaggtaaa

SEQ ID NO: 76 - DNA, 521 bp, Rattus norvegicus
gtgaccctgaggtgctgggccctgggcttctaccctgctgacatcaccctgacctggcagttgaatggggaggacctgacccaggacatggagcttgtggagaccaggcctgcaggggatggaaccttccagaagtggtcatctgtggtggtgcctcttgggaaggagcagaattacacatgccgtgtggagcatgaggggctgcctgagcccctttcccagagatggggcaggtacagctcccagagctccgttgtgtctctcccagattgtgaagcatgaagacagctgcctggagtggactgagtgacagacgatgtgttcaggtctctcctgtgacatccagagccctcagttctctttagacaccagtgtctgaagttccctgtgattctatggcttcagtgtgaagaactgtggagtccagcctgccctacacaccaggaccctgtccctgcactgcctgtgttgcctaccacattcagccttgctggtccagcctgggggtggagggtggggag

SEQ ID NO: 77 - DNA, 1341 bp, Rattus norvegicus
ccagcaatttcatctcctagacctcatcagactctgacccagttcttgaatgactttggagacccagatgtttcagaatgcacattctggaagccaatggctactcccaccactgacaatgttgctgctgtttgcttttgcagacaggcagacgggagatcttctgaaggctgtggtgaaacgtgatcccccatggatccaggtgctcaaggacgacactgtgacgctgacgtgcgaagggacccacaatcctggaaactcttctacccagtggttccacaaccagagctccacctggggccaggtccaagccagctacacgtttaaggccacagtcaatgacagtggagaataccggtgccgaatggcgcacaccagcctcagcgaccccatacatctggaagtgatttctgactggctgctgctccagacccctcaactggtgtttgaggaaggggaaaccatcacattaaggtgccatagctggaagaacaaacagctgactaaggtcttgttgttccagaatggaaaacctgtgaggtattattatcaaagcagcaatttttcaatccccaaagccaaccacagtcacagtgggaactactactgcaaagcatatctaggaaggacaatgcatgtgtccaagcctgtcaccatcactgtccaaggttcagcaaccgcgtccaccagctctctagtgtggttccatgccgctttctgcctagtgatgtgcctcctgtttgcagtggacaccggcctgtatttctgtgtacggagaaatcttcaaacctcgggggaggactggaggaaatccctgtcagtcggaaagtacaaggctccacaggacaaatgacatcccatcgtatggctaaacagcggcagcttcttttcagccacaccgccgcttcatctacagccttcctttgaaagcaacttaccaccaggctggatatttggtcctgcaatcacaactgctaggaggctgaggcaggaggatcaccaaaggctgcccgggttttagagaagagagagtgcaagtctatcctggataacccaataagaccctgggtttagatggcttatcaggaaagagcacccattgctaagctcacagacaagaccacagattgatccctaaggacacagggcaaagggggagaacaaattcctgaaagttgtcctctgacctccacacgtccaccatggcagatgcacacaataaacaaattaaaatgtaatatatatattttaaacaagaggtggggaaaggctgggggttggtggcacagtttttatccaggacacatgatgctctggattttgacctcctataataaaacg

SEQ ID NO: 78 - DNA, 628 bp, Rattus norvegicus
atggctgcaataccagaagaaggctcttgtgtcaacttcaaagaaatgatgtttattgacaacacactttaccttatacctgaagataatggagacttggaatcagaccactttggcagacttcactgtacaaccgcagtaatgcggagcataaatgaccaagttctcttcgttgacaaaagaaacccgcctgtgttcgaggacatgcctgatatcgaccgaacagccaacgaatcccagaccagactgataatatatatgtacaaagatagtgaagtaagaggactggctgtgaccctatctgtgaaggatggaaggatgtctaccctctcctgtaaaaacaaaatcatttcctttgaggaaatgaatccacctgaaaatattgatgatataaaaagtgatctcatattctttcaaaaacgtgtgccaggacacaacaaaatggaatttgaatcttccctgtatgaaggacactttctagcttgccaaaaggaagatgatgctttcaaactcgttttgaagaggaaggatgaaaatggggataaatctgtaatgttcactcttactaacttacatcaaagttaggtattaaggtttctgtattccagaaagatgattagcacacatg

SEQ ID NO: 79 - DNA, 1621 bp, Rattus norvegicus
agaagacttaaaacaaccctgacaccatgctctgacactatgtgggctctgatcttctgcttcctgagtcacccccgagacactggagcccgatcacactctctgcactattcttactcagccgtgacagagccgggcccaggagttcctgcattttttgccagtggctttgtagataaccagcccttcatccactatgacagtaggaagatggaggcagagccttgtgctgactggctgagggaaaatccatattactttgatgaggagacccaggttttcaccaatcggatgaagatctaccagttgaagcctgagaaacattcagcaatactacaacagctctggtgaccggagtcagagagcagatggcttctaccagcaagcaggccctcacaccctccagttcacgtacggctgtgagatgcaggacaacaggaccacagggcactggcagtatggctacgatggcagggattacctgaccttggacttggactctatgcaatatacagcagccaccttcattgctggctacaccaagcacaagtggcaaaacaatgagtactggctgcagagagagaagacctacttggagaaggagtgtgtcctgtggctaaagagatacttaactatgggaggagagaactttacccgagctgaccctccacagacaacagtgacacaccaccccagacctgaaggtgatgtcaccctgaggtgctgggccctgggcttctaccctgctgacatcaccctgacctggcagttgaatggggaggacctgacccaggacatggagcttgtggagaccaggcctacaggggatggaaccttccagaagtgggcagctgtggtggtgcctcttgggaaggagcagaagtacacatgccatgtggagcatgaggggctgcctgagccgcttacccagagatgggagcctccttcatccactgattccaacatggaaaccaatgtcatttatgttgtcgttggagccgtctctgctgtggccattattggagctgtgatcattggagctgtggtggctgttgtgaggaagaggaggagaaacacaggtggatatgaggagactacgcccctgctccagcatgaagacagctgcctggagtggactgagtgacagacgatgtgttcaggtctctcctgtgacatccagagccctcagttctctttagacaccagtgtctgatgttccctgtgattctatggcttcagtgtgaagaactgtggagcccagcctgccctgcacttcagaccctgtccctgcactgcctgtgttccctaccaaggccgaaccttgctggtccagcctggggggtcggtggtggagacatctgcatcctgaacctttgtgccaccctgagcttcagcccctcacttcacactgagaataagaatctgagtgtgagaggttggggatttagctcagtggtagaggactttcctagaaagcgcaaggccctgggttggatcctcagctccggggggaagggggggagaatctgagtgtgaacttgattgttcacatccttgacgcaagtgtggatggctttttaaattactggattcagaatacttaaaaaaaaaaaaaaaaaaa

SEQ ID NO: 80 - DNA, 582 bp, Rattus rattus
ggattgttacaaatcctcctttaatagttgatttcagagatgagcatatggaaaccctcccccaccctgcaaggcacagcctcacccacccttagcccaggggacaggggacagctgccaagaaataccagtccagatcctccttctcttgtccagacaactcagggtcttatgccagacctgagggacccatgcccctaagctgtcaggtccctcaccaaggaaaagctcactgggggctacctgggccagtcccccaggcagcctctccgttcagttccctgctgaactgagcttggggggagtattccaagtgtgtacaagaactgcctaccctgtctcccacagaaacattgaaaacccataaagaaagtgtcacagtggggaaaccactaacctttcctgtggcctttccctgggcagccatgggtgctagcccaccctccctggtttttaatattatattgttataatatgacttcagggtggggacccagctatcctgtgtacagtaatactgggagccatttcaagctgttaaaaatattccaggcagtaggaggaagagctacaggacagtaa

SEQ ID NO: 81 - DNA, 577 bp, Rattus rattus
tccatttttttttttttttttttttttttggttttttttagttttttatttttagtaaaaataacaaagcagaagtagccatgagggtgggggattgaactgctaggctgctaagcacagtgacagacttcagctaggcctcttcaccttaccaaaaagaaaatatctcaagtttcttaagttttttaaacaaatcacttatgctgtgataaaccaaagatgagtaactgcatccaactaataaaagtacagagggtttgacatatgatcaactcttgttcttaaccatatttattattctgatcaaaacactcattgaagctttattattccggaaatctaggatattagtctccaattttttttaaaacatgcataaaatatttaaggtaagatatgaagaagatggtgtgctcattgctattctttactttgtggataaattgtatagcatattagaaaccggatctggagttaaactggtccagatgattcagagctccatagagcttgattacatgtctcggtcccaggtgacggttttgggctccttcagagtgacgtgtttaactctgca

SEQ ID NO: 82 - DNA, 5066 bp, Rattus norvegicus
ctaccccttacccctcactccttccacctttgtcctttaccatgggacccacgtcagggtcccagctactagtgctactgctgctgttggccagctccctgctagctctggggagccccatgtactccatcattactcccaatgtcctgcggctggagagtgaagagactttcatactagaggcccatgatgctcagggtgacgtcccagtcactgtcactgtgcaagacttcctaaagaagcaagtgctgaccagtgagaagacagtgttgacaggagccactggacatctgaacagggtcttcatcaagattccagccagtaaggaattcaatgcagataaggggcacaagtacgtgacagtggtggcaaacttcggggcaacagtggtggagaaagcggtgctagtaagctttcagagtggttacctcttcatccagacagacaagaccatctacaccccaggctccactgttttctatcggatcttcactgtggacaacaacctattgcctgtgggcaagacagtcgtcatcgtcattgagaccccggacggcgttcccatcaagagagacattctatcttcccacaaccaatatggcatcttgcctttgtcttggaacattccagaactggtcaacatggggcagtggaagatccgagccttctatgaacatgcaccaaagcagaccttctctgcagagtttgaggtgaaggaatacgtgctgcccagtttcgaagtcctggtggagcctacagagaaattttattacatccatggaccaaagggcctggaagtttccatcacagccagattcctgtatgggaagaacgtggacgggacagctttcgtgatctttggggtccaggatgaggataagaagatttctctggccctgtccctcacccgcgtgctgatcgaggatggttcaggggaggcagtgctcagccgaaaagtgctgatggacggggtacggccctccagcccagaagccctagtggggaagtccctgtacgtctctgtcactgttatcctgcactcaggtagcgacatggtagaggcagagcgcagtgggatcccaattgtcacttccccgtaccagatccacttcaccaagacacccaaattcttcaagccagccatgcctttcgacctcatggtgtttgtgaccaaccctgatggctctccagcccgaagagtgccagtagtcactcagggatccgacgcgcaggctctcacccaggatgacggtgtggccaagctgagcgtcaacacacccaacaaccgccaacccctgactatcacggtaagcaccaagaaggagggtatcccggacgcgcggcaggccaccaggacgatgcaggcccagccctacagcactatgcacaattccaacaactacctgcacttgtcagtgtctcgggtggagctcaagcctggggacaacctcaatgtcaacttccacctgcgcacggacgctggccaagaggccaagatccgatactacacctatctggttatgaacaaggggaagttactgaaggcaggccgtcaggttcgggagcctggccaggacctggtggtcttgtcactgcccatcactccagaatttataccttccttccgcctggtggcttactacaccctgattggagctaatggccaaagggaggtggtggccgactcagtgtgggtggatgtgaaggactcctgtgtaggcacgctggtggtgaaaggtgacccaagagataaccgacagcccgcgcctgggcatcaaacgacactaaggatcgaggggaaccagggggcccgagtggggctagtggctgtggacaagggggtgtttgtgctgaacaagaagaacaaactcacacagagcaagatctgggatgtagtagagaaggcagacattggctgcaccccaggcagtgggaagaactatgcgggtgtcttcatggatgctggcctgaccttcaagacaaaccaaggcctgcagactgatcagagagaagatcctgagtgcgccaagccagctgcccgccgccgtcgctcagtgcagttgatggaaaggaggatggacaaagctggtcagtacaccgacaagggtctgcggaagtgttgtgaggatggcatgcgtgatatccctatgccgtacagctgccagcgccgggctcgcctcatcacccagggcgagagctgcctgaaggccttcatggactgctgcaactatatcaccaagcttcgtgagcagcacagaagagaccatgtgctgggcctggccaggagtgatgtggatgaagacataatcccagaagaagatattatctctagaagccacttcccagagagctggttgtggaccatagaagagttgaaagaaccagagaaaaatggaatctctacgaaggtcatgaacatctttctcaaagattccatcaccacctgggagattctggcagtgagcttgtccgacaagaaagggatttgtgtggcagacccctatgagatcacagtgatgcaggacttcttcattgacctgcgactgccctactctgtggtgcgcaatgaacaggtggagatcagagctgtgctcttcaattaccgtgaacaggagaaacttaaggtaagggtggaactgttgcataacccagccttctgcagcatggccactgccaagaagcggtactaccagaccatcgaaatccctcccaagtcctctgtggctgtgccttatgtcattgtccccttgaagatcggcctccaggaggtggaggtcaaggccgccgtcttcaaccacttcatcagtgatggtgtcaagaagatactgaaggtcgtgccagaaggaatgagagtcaacaaaactgtggctgtccgtacactggatccagaacacctcaatcaagggggagtgcagagggaggatgtgaatgcagcagacctcagtgaccaagtgccagacacagattctgagaccagaattctcctgcaagggaccccggtggctcagatggccgaggacgctgtggacggggagcggctgaaacacctgatcgtgaccccctctggctgtggggagcagaacatgattggcatgacacccacggtcattgcagtacactatctggatcagaccgaacagtgggagaaattcggcctagagaagaggcaagaagctctggagctcatcaagaaagggtacacccagcagctggctttcaaacagcccatctctgcctatgctgccttcaacaaccggcctcccagcacctggctgacagctatgtggtcaaggtctttctctctggctgccaacctcatcgccatcgactctcaggtcctgtgtggggctgtcaaatggctgattctggagaaacagaagccagatggtgtctttcaggaggacggaccagtgattcaccaagaaatgattggtggcttccggaacaccaaggaggcagatgtgtcgcttacagcctttgtcctcatcgcactgcaggaagccagagatatctgtgaggggcaggtcaacagccttcccgggagcatcaacaaggcaggggagtatcttgaagccagttacctgaacctgcagagaccatacacagtagccattgctgggtatgccctggccctgatgaacaaactggaggaaccttacctcaccaagtttctgaacacagccaaagatcggaaccgctgggaggagcctggccagcagctctacaatgtggaggccacctcctacgccctcctggccctgctgctgctgaaagactttgactctgtgcctcctgtggtgcgctggctcaacgacgaaagatactacggaggtggctatggctccacgcaggctaccttcatggtattccaagccttggctcaataccgggcagatgtccctgaccacaaggacttgaacatggatgtgtccctccacctccccagccgcagctccccaactgtgtttcgcctgctatgggaaagtggcagtctcctgagatcagaagagaccaagcagaatgagggcttttctctgacagccaaaggaaaaggccaaggcacactgtcggtggtgacagtgtatcacgccaaagtcaaaggcaaaaccacctgcaagaagtttgacctcagggtcaccataaaaccagcccctgagacagccaagaagccccaggatgccaagagttcgatgatccttgacatctgcaccaggtacttgggagacgtggatgctactatgtccatcctggacatctccatgatgactggctttattccagacacaaacgacctggaactgctgagctctggagtagacagatacatttccaagtatgagatggacaaagccttctccaacaagaacaccctcatcatctacctagaaaagatctcacactccgaagaagactgcctgtccttcaaagtccaccagttctttaacgtgggacttatccagccggggtcggtcaaggtctactcctactacaatctagaggagtcatgcacccggttctatcatccggagaaggacgatggaatgctgagcaagctgtgccacaatgaaatgtgccgctgtgccgaggagaactgcttcatgcatcagtcacaggatcaggtcagcctgaatgaacgactagacaaggcttgtgagcctggagtggactacgtgtacaagaccaagctaacgacgatagagctgtcggatgattttgatgagtacatcatgaccatcgagcaggtcatcaagtcaggctcagatgaggtgcaggcaggtcaggaacgaaggttcatcagccacgtcaagtgcagaaacgccctaaagctgcagaaagggaagcagtacctcatgtggggcctctcctccgacctctggggagaaaagcccaataccagctacatcattgggaaggacacgtgggtggagcactggcccgaggcagaggaacgtcaggatcagaagaaccagaaacagtgcgaagacctcggggcattcacagaaacaatggtggttttcggctgccccaactgaccaccacctccaataaagcttcagttgtatttt

SEQ ID NO: 83 - DNA, 1448 bp, Rattus norvegicus
cctctagatgcatgctcgagcggccgccagtgtggtggaattctgccaaactcggagagaagcctgtgcctgcagctgactcactccaggactgatgggaaccctgctgttcctaccgctccccatggacagcaacaggactgtcgtccatgtgctctcacggactttgtaccatatgctactgtggacagctgtgctaaatcttgttgctgagtctcatgcaggtcttccgaaggctgtggtgaaacttgagcccccatggatccaggtgcttaaggaagacactgtgacactgatgtgcgaagggacccacaacaccaagaactgttctactcagtggtttcacaatgggagctccatctggcatcaagcccaagccaactacacgtttaaggccacagtcaatgatagtggagaataccggtgccgaatggaggagaccggcatcagcgaacccatacatctgggagtgatttctgactggctgctactccagacctctcaactggtgtttgaagaaggggaaaccatcacattaaggtgccatagctggaagaacaaacagctgactaaggtcttgttgttccagaatggaaaacctgtgaggtattatcatcaaagcagcaatttttcaatccccaaagccaaccacagtcacagtgggaactactattgcaaagcatatctaggaaggacaatgcacgtgtccaagcctgtcaccatcactgtccaagagcccaaatccagcagttcgttgccggtattgacgattgtagctgctgtcgctggaattgctgtagctgccattgttattatcctggtatccttggtctatctcaagaaaaagcaggttccagacactccttctggtctcgaagaagctgagaaaaatgaggtggagaatacaatcacctattcacttctcaagcatcctgaagctccggatgaagaatcagatcacgactaccagaaccacatttagtctctcttgagattgggaaaagcaaaccagtaaggccaggacctagcgtctcctggtccaaggaatgctgtagatatgaaagaaaacatctagagtcccttctgtgagtcctgaaaccaacagacactacgatattggttcccaatggttgactgtactaatgacttccataacttacagcttcccaactaaagactcttttgctatagatccacacagccaataaaattaatcaacttactgttgttaagagactacagcaacgtgggaactgcttatattacatgctaaggagaacaagtaacattaggatgcataatctcagcgaggatcaactagacgtgtaccaacctgtcaaaagtgatgcttctttataagaaactttatttccttatttttctataaaggtcacatattacttttatagtaaaatgttgtgaaaatgtccaaaaaaaaaaaaaaaaaa

SEQ ID NO: 84 - DNA, 1052 bp, Rattus norvegicus
gcagcggggaccttattggactatctccccttaagtgggaagggcttagtcaaatgcagtaaagagctataaaacaccgagaactcttgatgtgttgtgaaacttagagggagcagctttttaacaagagaactcaagcaattgctgccatgccggggaagccagtccttcactatttcgatggcagggggagaatggagcccatccggtggctcctggctgcagctggagtagagtttgaagaacaatttctgaaaactcgggatgacctggccaggctaaggaatgatgggagtttgatgttccagcaagtgcccatggtggagattgatgggatgaagctggtgcagaccagagccattctcaactacattgccaccaaatacaacctctatgggaaggacatgaaggagagagccctcatcgacatgtatgcagaaggagtggcggatctggatgaaatagttctccattacccttacattccccctggggagaaagaggcaagtcttgccaaaatcaaggacaaagcaaggaaccgttactttcctgcctttgaaaaggtgttgaagagccatggacaagattatctcgttggcaataggctgagcagggctgatgtttacctagttcaagttctctaccatgtggaagagctggaccccagcgctttggccaacttccctctgctgaaggccctgagaaccagagtcagcaacctccccacagtgaagaagtttcttcagcctggcagccagaggaagccattagaggatgagaaatgtgtagaatctgcagttaagatcttcagttaattcaggcatctatggatacactgtacccacaaagccagccttcgaaagctttgcaacaatcgcatattttgactaaatgttgaccctacttattgggaggccaacacgttttctaatgcttctgtgttaattcatatagacatgactgatgaggaattgctgggatgctatttggttgtagttaaaatttgaaatcatgatcacttcctcagatattactttgaatctcaataaaaa

SEQ ID NO: 85 - DNA, 504 bp, Rattus norvegicus
tttttttttttttttttcctatagcatagtgtttattattccattatgtggaagacagtcaagataaactgctttttcaagatcgaaaaaatgttggccattacagttttctagtaaaagctagcaaagcccaggcaatattcagagatgtgggataattcaggttggagccgcccgtccacacttctacaagaacagacgttttgtgtgtttcctttcttttttgttttgttgttattgttgttttgaggtttttcttttctatgtatgtatgtatgtatgtatgtatgtatgtatgtatgtatgtatagacaggctttctctgtatagccttggctgtccgggaactggctggctttgacctcacggagatgcacctgcttctactcccaagtgctggtattaaaggcatgcaccaccactcgccattttgtttttcatttgaggcaaggtcttactatatagttttaggtgacttggagaccactgtgaaggtcaggctgg

SEQ ID NO: 86 - DNA, 551 bp, Rattus rattus
aatacaaagctttggcattagcaattttatgaaaaaataaaatgtactaaaaataaacgcttgtgtggcatgattggtaaatgatgcacaaaaataggttcttttttccttcaaggcaatcagtcagaaagcagtgttttccttcttcaaaaccattctaccttgttactgcaatgttgatttcacccgttcgaggagtgagctccccatcttgaggaagaggcgatatcccagaagttctcagtggctcaaggccaagggaactgtcattggcaaggtcaccaagggctgatcttcggttaactgcctgggttctggtgagcctttccatatcaaacgctacattatcagtacatggcagatttggcacaattcctagggctttcaaaatattaagtttacacataggacaggtacagtgttcactgagccagggatccacacaggatttgtggaaaacatgcttgcaggggagaacccgaacaacatcattctgcttatagctctctatgcagactgcacagtgatcgaagtctgggtctgtttcctta

SEQ ID NO: 87 - DNA, 2936 bp, Rattus norvegicus
gaattcggatccgcacccctcgggctgtgagtgttatctccgggcgccagccattctacctctgcctcattgttattctgtcctcccacaagctatgtcacaatcgggaaggacccttaagcacatagtccatctgcccagggccaagatgtcttcaacttgcaatttgcattgctgtggaatgtaaaccggtcccccacctggtatccttgagtgacccttcttggggccagcactcatctggctattcagcaggaaaacacacagaactactgcagactcccccagacctaaatcctctcttcaatactcttctagtcaccaggcccccaacaggaatcagtgtccacatctgccttcctctatcctctacaagaaggtgggggaccaaccagacttccacaacctagacacgaccctatgacacagggagagcatccccctgagtgtacaatacaaaatactcccatagaggaaataatgttgtaagaccagttggggagacatttcttccaggtctctcttcctcacttcctgaatccatttcactcctatcttgtagcctcaggataaggtgccagcctgcccttgagtaatccctagattcgtacaacctctgccggccaagttacacctgttgctgggtcaggcaggctcactctcaccctggcgagtgacacagaagtacagctagtgagtatagcttaccaatcatccctgtgagcaagctttccagggacgcttgtctaaactagcatttccccaaaaggtcttattaattagccagtggggcagaagccgggaatagcagcttttgaaacagtgttgcctcaggataaaagggcttgctagctggaaagttcacaacctgagtttgatctttagtacccctgttaatgtaggagagagccggctctacaaagctgtcctctgataatcacacacacacacacacacacacacacacacacacacacacacacacacacaccaacctggccatgggtgcccacacacaagtgcacacatgcatgcacacacacaataagtcctttttttttttttaaatcaacctacttttgtaattcttaagatgaagtctgtttgaaattgaggtcaaagataaatggatgaaaacagttcatttcatcttcatggggactcttagggaacattcattgttaagctctctgtaacttttttttttttttttttggagctggggaccgaacccagggccttgcgcttcctaggtaagcgctctaccactgagctaaatccccagccccaacttatttttttttacattgtgtgtgtgtgtgtgtctgtgtgtgtgtgtgtgtgtgtgtgtgtgtgtgtgtctgtgtgtgtgtgtgtacacgtgtgagctgtctggtcagagggcaacattcaggaatcaggtctctcatttcaccattgtgggttcagagcatagaactcaagtcactaggcttgatgactaagccttctccgggagtggggaattggggggggggaatcttcagatgcttttgtcgaaaggaatttatggcatctgggagtggagccgagaccacccccaaccctgctcttaagttccagcaggttagaagggaacacttgcttatacccactacctgagagcaaggaaggattttttttttttaaaccaagagacggggcattaccagctaaaccctaggattaaaatagatgagctgaactcttagttccaggtgagtggctgctagtcaggtgacacagctgctcccgtctccaggtgaagccacagtgtcccagtatcaggaggtctcatgtgctctgcctttcaaatctgtgtaagtcgctagggccaagcactcttcaaggtcaaacaccccacccagacaagtacctcacaaagccaagtactgcactgggggccagctgtgggaggacaggcaccccaccatccatgcatccacgtgccttggatgagggctcagttaattaacgcgagccgcctcagactcacacaaacaacggctgttttccttaaaccatcagattcaatatttacaaaaaaattaaaaagccaatgcgtcgtcctaaaaccataaaaccagccgcacaggccagtgtgtgagtctcccttctgcccagtaacaagaaaacctaagtcgtgtgccttgcccttcaaagcagaatagtaaagatagtagaaaaataaataaaaattgtaaaacagaactgtgtattgcatctgtcccccctaccccccttctcctgtagtggaacaaagtcaaacgctttttttttttttttttttttttttttggcctgggctgggcccccagtggctgaggccctgtaactttaaacctggcctgaggtcatcttgtgatgctggccaaacagaattcgggggcggtcctagatctccgggaccacctgacgcccacccgcccccgcccccgtactggagacttaaattgccgactgtgctgagaagttgccagttgccaagtttgctgtgcttgctccctccgctcgccttgaaagcccgggcactctctgtcgctgggactcttgctcaccgcttgccagcctcctcagagctcttctcggctgggcctgtggcttcgaagtttttttgttttttcatcttttcacaacccacaaaaaccactagctgctgaggctccaacgagatcaagatgtggaccgcgccagtgttgctctgggttttggggagcgtttggttctgggactcagcgcagggaggtaagcgccacgcctgattggcaaccccgcacttgctgatggggatggagggaggcgggggttgcttgggcctgggatctggaggtgccggggagagcggtggggcagcttagatggggcttagaagagtccccgggaacagcccagtgggtgtggcagtagaatcgggatcc

SEQ ID NO: 88 - DNA, 2153 bp, Rattus norvegicus
agggagcgcggaccccgacgcaggcagaccatgtggatcctggtgagctggctggccttagtggcaaggctggtggctggaacacagtgcccagatggtcaattctgccctgttgcctgctgccttgaccagggaggagccaactacagctgctgtaaccctcttctggacacatggcctataataacgagccgtcgtctagatggctcctgccagatccgtgaccactgtcctgatggctactcttgtcttctcactgtgtctgggacttccagctgctgcccgttctctgagggtgtatcttgtgatgatggccagcactgctgcccccggggcttccactgtagtgcggatgggaaatcctgctctcagatatcagatagcctcttgggtgctgtccagtgtcctggtagccagttcgaatgtcctgactccgccacctgctgtattatgattgatggttcctgggggtgctgccccatgccccaggcctcttgctgtgaagacagagtgcattgctgtccccacggggcctcctgtgacctggttcacacgcgatgcatttcacccacgggcacccaccccttactaaagaaattccccgcacaaaggaccaacagggcagtggctttccctttttccgtggtgtgccctgatgctaagacccagtgccctgatgactctacctgctgtgagctacccactgggaagtatggctgttgtccaatgcccaacgccatctgctgttccgaccacctgcactgctgcccccaggacactgtatgtgacctgatccagagcaagtgcatatccaaggactacaccacagatctcatgaccaagctgcctggatacccagtgaatgaggtgaagtgcgacttggaggtgagctgtcctgatggctacacctgctgccgcctcaacactggggcctggggctgctgtccattcaccaaggctgtgtgttgtgaagaccacattcactgctgcccagccgggtttcagtgtcacacagagacaggaacctgtgaactgggagtccttcaggtaccctggatgaaaaaggtcacggcctccctcagcctgccagacccacagatcttgaagaatgatgtcccctgtgatgacttcagtagctgtccttctaacaatacctgctgcagactcagttctggggactggggctgctgtcccatcccagaggctgtctgctgcttagaccaccagcattgctgccctcagggtttcaaatgtatggatgaggggtactgtcagaagggagacagaatggtggctggcctggagaagatgcctgtccgccagacaactctgctccaacatggagatattggttgtgaccagcataccagctgcccagtagggcaaacatgctgcccaagcctgaagggaagttgggcctgctgccagttgccccatgctgtgtgctgtgaggaccggcagcactgttgcccggctgggtacacctgcaacgtgaaggcgagaacctgtgagaaggatgcaggctctgtccagccttccatggacctgacctttggctctaaggttgggaatgtggaatgtggtgccggacatttctgccatgataaccagtcctgttgtaaagacagccaaggaggctgggcctgctgtccctatgtaaagggtgtctgctgtagagatggacgtcactgttgtcccattggcttccactgttcagccaagggaaccaagtgtttgcggaagaagacccctcgctgggacatacttttgagggatccagccccaagaccgctactgtgaggaagggctaacgactaaagaactccacagtcctgggaaccctgttctgagggtatccaccactcaggcctccctggcacctcttcctttagtctccccggcctactcattctgagtcaccccatcaccatggaaggtggggcctcaaactaagaccttctcttatggaaagaaggctgtggcaaaagccccgtatcaaactgccatttcttctgatttctgtggaccttgtggccaggtgctcttctcgatccacaggtgttgtgtgagcttgcttttgtgtgtgtgtgtgtgcgcgcgtgcgagcgtgttgctccaataaagtttgtacactttcaaaaaaaaaaaaaaaa

SEQ ID NO: 89 - DNA, 1712 bp, Rattus rattus
gaattccggctctgtctcacccaggatgagtttcatcctttcattgaagcacttctgccccatgtccgcgccttcgcctacacatggttcaacctgcaggcccgaaagcggaaatacttcaaaaagcatgagaagcgcatgtcgaaagaagaggagagggctgtgaaggatgaactgctaagtgagaagcctgaggtcaagcaaaagtgggcttcccgacttctggccaagttacggaaagatatccgacccgagtaccgagaggattttgttcttacagttacagggaaaaaacctccatgctgtgttctttccaacccagaccagaaaggcaagatgcggagaattgactgcctccgccaggcagataaagtatggaggttggacctcgtcatggtgatcttgttcaaaggtattccgctggaaagtactgatggtgaacgccttgtgaagtccccacagtgctcgaatccagggctctgtgtccagccccatcacataggggtttctgtaaaggaactcgatttatatttggcatactttgtacatgcagcagattcaagtcaatctgaaagtcccagccaaccaagtgatgctgacattaaggaccagccagaaaatggacatttgggcttccaggacagcttcgtcacatcaggtgttttcagtgtgactgagctagtaagagtgtcacaaacaccaatagctgcaggaaccggccccaatttttctctctctgatttggaaagttcctcatactacagcatgagtccaggagcaatgaggaggtctctacccagcacatcctctaccagctctaccaagcgcctcaagtctgtggaggacgaaatggacagtcctggtgaagaaccattttacacaggccaagggcgctccccagggagtggcagccagtccagcggatggcatgaagtagagccaggcatgccatctccaaccactctgaagaagtctgagaagtctggtttcagcagcccctccccttcgcagacctcctccctcggaacagcattcacacagcatcaccgacctgtcataacaggaccgagagcaagcccacatgcgacgccatcgactctccactttccaacgtcacctatcatccagcagcctgggccttatttctcacacccagccatccgttaccaccctcaggagacgctgaaggagtttgtccaacttgtctgccccgatgctggtcagcaagctggacaggtggggttcctcaatcccaatggaagcagtcaaggcaaggtgcacaacccattcctccccaccccaatgttgccgccgccaccgccaccaccgatggccaggcctgtgcctctgcccatgccagacaccaagcctccaaccacatcaacagaaggcggtgcagcctcccccacctcaccgacctactcgacacccagcacctcccccgcaaaccgattcgtcagtgttggaccacgggatccaagctttgtaaatatccctcaacagacacagtcctggtacctgggataaaagttgcagcgtcccaccatcctccagacagaccacctgaccccttctcaactctgtaacatggacgcaacctcaacccggcgcagttacaacttcactgtcagtggaaggggagagacaccaactcgaatcaacttgtacatggaaacagcgaacgtcgtggtcaaacagcaaaggccgaattc

SEQ ID NO: 90 - DNA, 1940 bp, Rattus norvegicus
ggaattcggcacgaggtgatttccagcttttggaagccccggtgctttacgaaatcacggtagccggagagccatggagatggaacagttgaccttccgagatgtggctgttgacttctctccggatgagtgggaatgcctggaccctcctcagcagaggctgtacagggacgtgatggtagagaactacagaaacctggtctctgtggctctttctcatcattgtacccagaacttttcaccagaacagatcctaaaatattccttcacaaaaggaactaatggaagttgtggccttaaaagtttatacttaagggaagattgtatatatatagatgagagtaaagcccaccatggtagagatatgcaatgtctaattacaagcaataccaaagatgtcattgacagcagagatcaagaacacaaaaccgctctgacaataactcctgtgaggccagatactttggatgagccaagtatctataactgtaaatatccacaggaaagttttcagcatgacttaactttgaaagaaagtttggaagatctgatagatgggttaatgtttcacccaaacagttccatagataaagaattaagaagcagaggactgatatcaacaagtgatcaaattgagactttctatactgaaagatccttactcttcagtcagcaaatagctatctcctatgacccaaagcacaattctattgattatggattgcctgctattgatccattatcacatagcccaaatggcgatacagatgtgtgggaaagccctttcatgtataaggaaactagcaaagattttagtagtgaatctttactaaataactgcaatgatattatcttagagaaatctagtcagtataacaaaatatgtaacgactttgaccattgctcaagtcccaacaaatatcagtatactcttccaaagaagcctttcaattgtgataatttctttactcaatgttcaaagctttctatccatcaatatgttcaagataattgttacaagagtatcgattgtgacacaatgtttaataaaactttaaatgttattacacataaaattcagcattcccagaaatcctacaaatgtaatgaatgtggcaaagcttttaaatattgctcaagttacagaaaacacagaataattcacacaggagaaaaacccttcaaatgtaaagtatgtggaaaatcctttacccaatgtgcaagccttaaaaaacatcagagaatccacacaggagagaaaccctacaaatgtgaagaatgtggcagaagctttaaccactactcaattcttggtcagcaccagaggattcatacaggagagaaaccctacaagtgtaaacagtgtgggaaatcctttactcaatgttcaagccttcagaaacaccaagtaatccacactggagagaagcccttcagatgtgcagaatgtggcaaatcctttacgcaaaactcaacccttagtcaacaccagagaattcatactggagaaaaaccttacaaatgtgaacagtgtggaaaggcctttacccaatgttcaagccttagaaaacaccagagaattcacactggagagaaaccctacaaatgtgaagaatgtggcagagcctttaactgccgttcatcttttactaaacacacaagagaattcacacaggagagaaaccttacaaatgtaaagactgtgacaaagctttcatccactgcacaaaccttactcaacaccggagaatccatacaggagagaaaccatacaaatgtaatgaatgtggaaagtcctttagtcagtgttccaaccttagaaaacatgagagaattcatacatgagtaaaactaacaaatgtaaagaatttagtaaatcttttatccatatgcaaaaaaaaaaaaaaaaaaaaaaaaaaaaaaaaaaaaaaaaaaaaaaa

SEQ ID NO: 91 - DNA, 4665 bp, Rattus norvegicus
attgcttgcttcctaggggccagggctgttctgagcacgtcacaccaatccaagcttcacaaacacctatgggcagttgaagagggggaggcctcggacttctcgctggcctgggattcctctgtggcagcagcgggaggcctagaaggagagtcagagtgtgatcggaaatccagccgtgcgctggaagacaggaacagcgtgacaagtcaagaggagagaaacgaggacgatgaagatgtggaagatgagtcaatttacacctgcgatcactgtcagcaggacttcgagtctctggcagacctgacggaccaccgggcccaccgctgtcctggagatggtgatgacgacccacagctctcctgggtggcttcatctccctccagcaaggatgttgcgtcacccacgcagatgatcggcgatggttgtgaccttggcctcggcgaggaggaaggcggcaccggcctgccgtacccttgccagttctgcgacaagtccttcatccgcctgagctacttgaagaggcatgaacagatccacagcgacaagctgccgttcaagtgcaccttctgcagccgcctcttcaaacacaagaggagccgggaccggcacatcaagctgcacacaggcgacaagaagtaccactgccacgagtgcgaggcggctttctcccgcagggaccacctcaagatccacctgaagacccacagctccagcaagccgttcaagtgcagcgtgtgcaaacgcgggttctcctccaccagctccctgcagagccacatgcaggcccacaagaagaataaggaacacctggctaagtcagagaaggaagccaagaaggacgacttcatgtgtgactactgcgaggacacctttagccagacagaagagctggagaagcatgtgcttaccctccacccgcagctctcagagaaggcggacctccagtgtatccactgccccgaggtctttgtcgacgagagcacgctgctggcccacatccaccaagctcacgccaaccagaaacacaagtgccccatgtgccctgagcagttctcctccgtggagggtgtgtactgccacctggacagccaccggcagcctgattccagcaatcacagtgtcagccccgaccccgtgctgggcagtgtggcttccatgagcagtgctacacctgactcgacgcccgaccccgtgctgggcagtgtggcttccatgagcagtgctacacctgactcgagcgcctctgtggagcgcgggtccacgccagactccaccttgaagccgctgagggggcagaagaagatgcgggatgacgggcagagctggtccaaggttgtctacagctgcccctactgttctaagcgggactttaccagcctggctgtgctagagattcatctgaagaccattcacgcggacaaacctcagcagagtcacacgtgtcagatttgcctggactccatgcccacgctctacaacctcaacgagcatgtgcgcaagctgcacaagagccacgcttaccccgtcatgcaattcggcaacatctccgccttccactgcaactactgccccgagatgttcgcggacatcaacagcctgcaggagcacatccgagtctcgcactgtggccccaatgccaacccccccgacgggaacaatgctttcttctgtaaccagtgttctatgggctttctcactgaatcctccctcacagagcacatccaacaggcacactgcagtgtggggagcaccaagctggagtctcccgttatccagcccacacagtccttcatggaggtctactcctgcccttactgtaccaactcccctatctttggctccatcctgaagctcactaagcacatcaaagagaaccacaagaacatcccgttggcacacagcaagaagtccaaggcggagcagagtccggtctcctctgacgtcgaggtgtcttccccgaaacgacagcgcctctcggggagtgccaactccatctctaacggcgagtacccctgcaatcagtgcgacctcaagttctccaacttcgagagcttccagacccacttgaagctgcacctggagctgctgctccggaagcaggcctgcccccagtgcaaagaggacttcgactctcaggagtccctcctgcagcatctgaccgtgcactacatgaccacgtccacccactacgtctgcgagagctgtgacaagcagttctcctcagtggacgacctgcagaagcacctgctggacatgcacacctttgtgctataccactgcaccctgtgtcaggaggtcttcgactctaaggtgtccatccaggtgcacctggccgtgaagcacagcaacgagaagaagatgtaccgttgcaccgcctgcaactgggacttccgcaaggaggctgacctgcaggtgcacgtcaagcacagtcacctcggcaacccggccaaggcccacaagtgcatcttctgtggtgagaccttcagcaccgaggtggagctccagtgccacatcaccacgcacagcaagaagtacaattgcaggttctgcagcaaagccttccacgccgtcctcctgctggagaagcaccttcgggagaagcattgtgtgtttgacccagctgcagagaatggcacggccaacggggtgccccccacctccaccaagaaggcagagcccgccgacctgcagggcatgctgctcaagaaccctgaggcaccgaacagccacgaggccagtgaggacgatgtggatgcatcagagcccatgtacggctgtgacatctgtggtgcagcctacaccatggaggtgctgctgcagaaccaccgactccgggatcataacatccggcccggagaggacgatggctcacgcaagaaggcagagttcataaagggcagccacaagtgtaacgtgtgctctcggactttcttctcggagaacgggctccgggaacacctgcagacgcaccggggccctgccaagcactacatgtgtcccatctgtggcgagcgcttcccctcgctgctgacgctcactgagcacaaggtgacccacagcaagagtctggacacaggcacctgtcgcatctgcaaaatgcccctgcagagtgaggaggagtttatcgagcactgccagatgcaccccgacttgcggaactccctcactggtttccgctgtgtggtctgtatgcagactgtcacctcaaccctggagctcaagatccatggcacctttcacatgcagaagctggctggcagctcagctgcttcctcccccaatggccaggggctgcagaagctctacaagtgcgccctgtgcctcaaagagttccgtagcaagcaggacctggtcaggcttgacgtcaatgggctgccctatggcctatgtgccggctgcatggcccgtagtgccaatggacaggtgggtggcctggccccacccgaacctgccgaccggccctgcgctggcctccgctgccctgaatgtaacgtgaagtttgagagtgctgaggacctggagagccacatgcaggtggaccaccgtgatcttaccccagagaccagtgggccccggaaaggtgcccagacgtcaccagtgccccggaagaagacgtaccagtgcatcaagtgccagatgaccttcgagaacgagagagagatccagatccacgtcgccaaccacatgatcgaggaaggcatcaaccatgagtgtaagctgtgcaaccagatgttcgactccccagccaagctcctttgtcacctcatcgaacacagcttcgagggcatgggtggtactttcaagtgccccgtgtgcttcacagtcttcgtccaggccaacaagctgcaacagcacatcttcgccgtgcacgggcaggaggacaaaatctacgactgctcgcagtgcccacagaagtttttcttccagacagagttgcagaaccacacgatgagccagcacgcacagtgagggacctcgcgacaggacacctctccgcagaaggcttgccggagacgccgtggggagggccatttgaacattacatccaatcaaagtgtcatttgcaacccagatgtaaaactctaatgatttggccatgaggcgctgctattataagcagctggaaatgaatattaatggcagagattaaaagtattccatgctcagtgttttttattgtcctgctacagctagtgtgcttttagagttttcgccgcagactacatttctagtgttagagaaacctgcttttttgaggctattgtcctttgttccttcatgtattatattgatagttttttttaaaggattagtgtgattttttttgcttcttttctatttctttctttcttgtttttctttctcccccttcagttaactactttttaattgaaattctaggtaattgtgcatcgtgatgtgattgcttggctattgtctgaatatttccttttaattttttaattaaagactaatgctttgattggatttgccagttcaccggacagtgattaaaactctgtaatgaaaataatcggtttccgtgcaactggatggtctgcttttaaatgtgacttgatctgactgcagtaactagttcagctcaataaagggaatccatgcgttcacccccaaaaaaaaaaaaaaaaaaaaaaaaaaaaa

SEQ ID NO: 92 - DNA, 3115 bp, Rattus rattus
gaattccggtccgcagcctaggggcggggcgcggacgacggagccatggattgcacatttgaagacatgcttcagctcatcaacaaccaagacagtgacttccctggcctatttgatgccccctatgctgggggtgagacaggagacacaggccccagcagccctggtgccagctctcctgagagcttctcttctcctgcttctctgggctcctctctggaagccttcctgggaggacccaaggtgacacctgcacccttgtcccctccaccatcggcacccactgctgtaaagatgtacccgtccgtgccccccttctcccctgggcctggaatcaaagaggagccagtgccactcaccatcctgcagcccccagcaccacagccatcgccagggaccctgttgcctccgagcttccctcctccacctgtgcagctcagccctgctcctgtgctggggtactcaagcctgccttccggcttctcaggaacccttcctgggaacacccagcagacgccatctagcctgccactgggctccacgccaggaatctcgcccacccccttacacacccaggtccagagctcggccgcccagcagccgccgccagcctcagcagcccctagaatgagcactgtggcctcacagatccagcaggtccccgttgtactgcagccacacttcatcaaggcagactcgctgctgctgacagctgtaaagacagacacaggagccacaatgaagaccgcaggcatcaacaccctggctcctgcgacagccgtgcaggcaggccccttgcagaccctggtgagtggagggaccatcctggccacagtcccactggtggtggacacagacaaactgcccatccaccgactagcagctggtggcaaggccctgggctcagctcagagccgtggtgagaagcgcacagcccacaatgccattgagaagcgctaccgttcctctatcaatgacaagattgtggagctcaaggacctggtggtgggcactgaggcaaagctgaataaatctgctgtcttgcgcaaggccatcgactacatccgcttcttacagcacagcaaccagaaactcaagcaggagaacctgaccctgcgaagtgctcacaaaagcaaatcactgaaagacctggtgtcagcttgtggcagtggaggaggcacagatgtgtctatggagggcatgaaacctgaagtggtagaaacgctgacccctccaccctcagacgccggctcaccctcccagagtagccccttgtccttgggcagcagaggcagcagcagtggtggcagtgactctgagcccgacagcccagcctttgaggataaccaggtgaaagcccagcggctgccttcacatagccgaggcatgctggacccgtcccgcctggccctgtgtgtactggtcttcctgtgtctgacctgcaacccattggcctcactgtttggctggggcatcctcactccctctgatgcttcgggtgtgcaccgtagttctgggcgcagcatgctggaggccgagagcagagatggctctaattggacccagtggttgctgccacccctagtctggctggccaatggactactagtgttggcctgcttggctcttctctttgtctacggggaacctgtgaccaggccacactccggcccggctgtacacttctggagacatcgcaaacaagctgacctggatttggcccggggagattttgcccaggccgctcaacagctgtggctggccttgcaagccctgggccggcccctgcccacctcaaacctggatctggcctgcagcctgctttggaacctcgtccgccacctgctgcagcgtctttgggtgggccgctggctggcaggccaggctgggggcctgcagagggactacaggctgagaaaggatgctcgtgccagtgcccgagatgcggctgtcgtctaccataagctgcaccagctgcatgccatgggcaagtacacaggaggccatcttgttgcttctaacctggcactgagtgcccttaacctggctgagtgtgcaggagatgctatatccatggcaacactggcagagatctacgtggcagctgccctaagggtcaaaaccagcctccccagagccttgcacttcttgacacgtttcttcctaagtagtgcccgccaggcctgcctggcacagagtggtgcagtgcctcttgccatgcagtggctctgccaccctgtaggtcaccgtttcttcgtggatggggactgggctgtacacggtgccccccaggagagtctgtacagcgtggctgggaacccagtggatccactggcccaggtgacccgactattctgtgaacatctcctggagcgagcattgaactgtatcgctcagcccagcccaggggcagctgatggacacagggagttctcagatgcccttggatatctacagttgctaaatagctgttctgacgctgtcggagctcctgcgtgcagcttctctgtcagttccagcatggctaccaccactggcacagacccagtggccaagtggtgggcctcactgacagccgtggtgatccactggctgaggcgggatgaggaggcagctgaacgcttatacccactggtagagcacattccccaagtgctgcaggaaactgagagacccttcccagggcagctctgtactccttcaaggctgcccgggctctgctggaccacagaaaggtggaatccagcccagccagcctggccatctgtgagaaggccagtgggtactgcgggacagcttagcctctacatcaactgccagttccattgacaaggccgatgcagctgctcctgtgtgatctacttcttgtggcccgcaccagcctatgcggcgccaacagtcagcagcttcagcccagggagctcacggtaccagcaatggaccccaggcctctgctctggagctgcgtggtttccaacatgacctgagcagcctgaggcgcttggcacagagcttcggcctgctatgaggagggtcttcctacatgaggccacagctcggctgatggcaggagcaagtcctgcccggacacaccagctcctggaccgcggaattc

SEQ ID NO: 93 - DNA, 472 bp, Rattus rattus
aaggcaaggtctctgtcattagggctgggagagatggtacagatcaagccaaacagtgaaaaataaggcaaactgtagcttcgggttttgagcctggcaccaggaaggcctcttcttgaggaagagggggcaggcagtggcaaatcagcagacgagatgcaaatggagtaacaatcacagttagtggggtaacgagatcaggcggtaaacccttaaagcaacacccaaggtccacgtctttgcatgtgcagggcacaactccagcagcagtttctgggtttgggggtttgttacttttccgactttccccaccccctaaaagacacgaagacgagctcatgaagagatcaaggaagggacgtcttctggctgcgctgggcaagggttgggtgacttccgggagcacttgtctaccttccctgtggctggccgagtcctacaaacgtttgtaggtgcccaggagcgctttgca

SEQ ID NO: 94 - DNA, 616 bp, Rattus rattus
aagtcatgatattcctttattagtgctagctccttttaatttttatcagagctaaacaatttaatataaaaatgtcatttcttgttcatacagtatataaaaaagtatagtggtttggttagttttcaatagtttgcttttagccagatgtcatataagtctatgactgtaacaaatgagaacagtataaataagttctgtagtatttacacttacacagaaactagcccaaatggtgcccaagaaattaacttgagagttaaaatgaaactgattcaacattgagactttaatgctttgtaaagtttcatattatttctacactagctttggctataattctgcatagttacttataaagtgtttctgcatttcacatcacagtaggaagttttagccgtacaaaacaaacactagctcagaaaaggctccatcctcccgaacctagtttttctttgtatctggcttcttgctcttgggaacaaggaacacgttgccatctctggtctgctgcagagagtactcactgggagagtaaggtttcccatcctcatcacgtaacatgctgaagacttccagatacaaagtgctgagttttcttttcagaagatggagg

SEQ ID NO: 95 - DNA, 1686 bp, Rattus norvegicus
gatccaagaatgggtgccgtggctgcctgaaaggccagtgcggaaagacgaaagggtccagaacaggcaacagttttgcaggttagcttcacatcggaaatcacttttgtctgagcatccttttagagtgtctgtcttagggatgcctctgtagtggtctctccatgtggtaaccactctacctgtgggagtctttcttcggagtcctctgaatgtgccaacatcccctgtaggctctattctaaaggccccttctcactctctgtcttagggtcaagaggttatctgtctccaactttgatttatattgagacaggaatctccaccctccccacatactggttactgttcctggtagagaagtctagggctggcaaaggcacaattgaagtcagggctggctcaatcgggccatcttctctgccccataccctccctacctctggctaagggggtcggagtgtgctcagcacaagaacccatcgaccttccccgctactgtccatggttgacaaggtctagaaaggagctctccaaactcaagtccgcaacccacaaagtgtttggcctggacaccagggccacgggggtccaggaacggaagaaacatgcctactcatccccctcatttatgtccatccgtcatttatgtcccacataatcctgcaaggaccgttgcttgctttcctaaagtcacttcctgactaatctctgcctgagcccgcttggaaggagggacccgggagctgataaagaaaagaaggtctccaggctctctgcagagtcagaaagtgtaactcaccggggcaagaagatgggacgcagctaaccgatctggagcccttgaggctgaagtttttaagcaccagggaaaggagaaagccactcccaagtccaaagtgtcaagtttcctcctccgctgattcgagagagggagccgcccctgctgtactagccaccccaccacaggcctgcgactggacacagcttgatgaggagggatcataggtccttatctctcccaattatgagtgctactcgggagtctgtgttagaagggactgctgctgctgctgctgctgctgctgctgctgctgctgctgctgctgctgctgctgctgcttgaaaaaattaaaaacaaaacaaaaccaaatgtacttggggaaatcagcactgggaagccccttctgagaaattcgaggtccaaaggcacttggagagccccaaactaaagccccgtagtgggacccctattgaaattctccactgagttctaagacagaagcccctcttggagacgcacaggctaagcactcctgggcagaatccttccctttccctgctcagccggtaccgcagcacccagcaccacagcacccttcccacgacctccttctctttcacctccttcacgcaagattcggggaggtggtgcaagcaggagtggaaagaaacagcagacatccattccctcctgggagacagagggcgcctctgtccactcctggccctagcccttcgggtgtcgtttgtgaaggggtggagccgtcgggaggagggtcggcagtaaagacaggtctccccacactgctccggggccacatttgcagcgcgcccttctgtcaagaacctgctccgacgtcagccgaggccaaccgtgagtatcctaccctgcttagataatcg

SEQ ID NO: 96 - DNA, 464 bp, Rattus rattus
aaattcaatctagaattaaagacctactaatgattttttatttggcttaggaagttggaatctgtgttgttcaaagccattaaacataaatcaggatactaaaaatggctgcctttgctaaatgtaatttttgtatttgttttccgtaactactaatactgtatgttgcctggtgccaacaaatacttcaaaatacatttgttgtaaatgctgtcagtgcctctattacttgattagtgtggtctaaaaagctaataatgaaatgacatggtggtgcacacctataatcccaacacttaggaggtagacacaggaggatcaatagtttggggtcatccttgtgaaagtgcaggagatataaataagtctattaactgtttagcatggtcaatgctcggacccagggaaggagaatggtgtcctatggattcttgtcaggcaaatgaagtaatgctgtctatatt

SEQ ID NO: 97 - DNA, 524 bp, Rattus norvegicus
gttggtgatggagcttgtggtaagacatgcttgctcatagtcttcagcaaggaccagttcccagaggtttatgtgcccacggtgtttgaaaactatgtggcagatattgaagtggacgggaagcaggtagagttggctttatgggacacagctggacaggaagattatgaccgtctgaggcctctctcctacccagacactgatgttatactgatgtgtttttccatcgacagccctgatagtttagaaaacatcccagaaaagtggactccagaagtcaagcatttctgtccaaatgtgcccatcatcctagttgggaacaagaaggatcttcggaatgatgagcacacaaggcgggagttagccaaaatgaagcaggagccggtaaaacctgaagaaggcagagatatggcaaacaggattggcgcttttgggtacatggagtgttcagcaaagaccaaagacggagtgagagaggtttttgagatggccacgagagctgctctgcaagctagacgcgggaa

SEQ ID NO: 98 - DNA, 1217 bp, Rattus norvegicus
ctcggccaacccccgccgtagctgccgctgctcccgccgtcaccgcctccgagaacatggctgtgcctcccacatatgctgatcttggcaagtccgccagggatgtcttcaccaagggctacggctttggcttaataaaacttgatttgaaaacgaagtccgagaatggattggaatttactagctcaggttctgccaacacggagaccaccaaagtgacgggcagtctggaaaccaagtacagatggaccgagtatgggctgacgtttactgagaagtggaacacagacaacaccctgggctctgagatcaccgtggaagaccagcttgctcgtggactgaagctgacctttgattcatctttctcgcctaacactgggaaaaaaaatgctaaaatcaagacagggtacaagagggagcatatcaacctgggctgtgatatggactttgacatcgctgggccctcaatccggggcgctctggtgcttggctatgagggttttgacatcgctgggccctcaatccggggcgctctggtgcttggctatgagggttggcttgctggctaccagatgaattttgagacctcgaagtcccgagtgacccagagcaactttgcagttggctacaagacggacgaattccagcttcatactaatgtgaatgatgggacggagtttggtggctccatttaccagaaggtgaacaagaagttggagactgctgtcaatctcgcctggaccgcaggaaacagtaacactcgctttggaatagcagccaagtatcaggtcgaccctgatgcctgcttttcggccaaagtgaacaactccagtctaattggcttagggtacactcagaccctaaaaccaggtatcaaactgacactgtcagccctgctggatggcaagaacgtcaatgcgggtggccacaagcttggtttaggactggagtttcaagcgtaaatgaatattgtacaatcgttaattttaaactattttgcagcatagctaccttcagagtttagtgtaccttttaatgtcatatgttggggatgcgagagttgattgataccacgttagacctccaggctaaggatgactcggctttaaggtgtttaccgtttcagaggtacagcggaaaccccattccaggaagggtcctttttagctgtaggcgttgggctggggaggagctcctctagagatccgaggctcgaa

SEQ ID NO: 99 - DNA, 602 bp, Rattus rattus
gatggctaactaaggactttatttcaaacaaaaattaaaaattaaaaaaaaaaaaaaatgagagctatttccctgggtgtgaggaaaggatcagggtgagaaatttccccatggctaagccaataccctcaatatattagagggatcgtgtcagttcccttccttacccccatgatggggaacctaagcaagtgcaggacccacctgtcgggaatgtgggctaggggtcagcccccaaatggggacagagttgggcagcagcatggccaaacataggattaagtcctaagtaccaagaacccactcctcccatcttgctgggacccagggaaagtaaaagatggttttgtagaaaacctctgagatccccgaggggaagaaggttccagtcctcctcatgttcatcatctctgttctctggagggcagtgagtcctgggatctgtcaggtggcaatactgacacagcaagaggtggggaagccccagcaagtctggaccccatggttggctctcctaccctttggccagctctcatggttaccacatgatcctttgtgttttttgccttccatttcccttgggtaggtggttaggtaggtgg

SEQ ID NO: 100 - DNA, 560 bp, Rattus norvegicus
ggaggtggaggaggaggagggggggggggggaagagggggaggagaaggaggattcattattgcagggattggactcagagaaacagacccagggcatggagacaggtggtgcctaggaggaggaggcggtcctgaggggctgcaccccaggggagggggcggggctgggaatgggatctgcagaaccgccagccatcccagccctgagctgcaacagccatgtccaacaacatggccaagatcgctgaggcccgcaagacggtggagcaactgaagctggaggtgaacatcgatcgcatgaaggtgtcgcaggcggcagcggagctattggctttctgcgaaacgcacgctaaggatgacccactggtgactcctgtccctgccgccgagaatcccttccgcgacaaacgactcttttgcaccctgctctgagcccccaagatagttttatcctcccgcgcagaaatatgaatccaataaacttggtgacttggtggtgcctgccatttaggggaaaatgaggcacggggcaaaaacgtgggggccacctttgtgggga

SEQ ID NO: 101 - DNA, 3185 bp, Rattus norvegicus
ggctaggaagcccgcttcacgtccccacgcttgttccctccacctcgctctcctgagagcagagagcgcgcggtgtgcagactcggagcattccgggaggatgaggcggggacccagcccaagttgggtgcatcttgcgggcgtgaggccacaactgggtttcggcatgaattaagaagcttgaaagatggagcgcagcacagtccttatccaacccgggctctggaccagggacaccagctggacactcctctatttcctgtgctacatcctccctcagacctcccctcaagtgctcaggatcggagggatttttgaaactgtggaaaatgaacctgttaatgttgaagaattagctttcaagtttgcagtcaccagtattaaccgaaaccgaaccttgatgcccaataccacattaacctatgacatccagagaattaatctttttgatagttttgaagcctcccgaagagcatgcgaccagctggctctcggggtggccgcactcttcggcccttcccacagctcctccgtcagtgctgtacagtctatttgcaatgctctggaagttccacacattcagactcgctggaaacacccttccgtggacagcagagacctattttatatcaacctctacccggactatgcggctatcagcagggcggtcctggatttggtcctctattacaactggaaaacagtgacggtggtgtatgaagatagcacaggtctaattcgtctgcaagagctcatcaaagctccctccagatacaacattaaaatcaaaatccgccagcttccccctgcgaataaagacgccaaacctctgctcaaggagatgaagaaaagcaaagagttctatgtgatatttgattgttcgcacgaaacagctgcggaaattcttaagcagattttgttcatgggcatgatgactgaatattatcactacttcttcacaaccctggacttgtttgctttagatctggaactctataggtacagcggtgtaaatatgactggatttcggttgctgaatattgacaaccctcacgtgtcatccatcattgagaagtggtccatggagaggttgcaggccccgcccagacccgagactggtcttctggatggcatgatgacaactgaagcagcgctgatgtacgatgctgtgtacatggtagccattgcgtcccaccgtgcctctcagctgaccgtcagctccctgcagtgccatcgacataagccatggcgccttggacccagatttatgaacctcatcaaagaggctcggtgggacggcttgactgggcggatcaccttcaataagaccgatggcttgagaaaggattttgacctggacattatcagtctcaaagaggaaggaactgaaaagattgggatttggaactccaacagtgggctgaacatgacggatggcaacagagacaggtccaacaatatcacggactcgctggctaaccgcacactcattgtcaccactattctggaagagccctacgtgatgtacaggaaatccgataagcccttgtatggaaacgacaggtttgaaggatattgcctggatctgctgaaagaactgtccaatatcctgggttttctttacgatgttaaactggttcctgatggcaaatatggagcacagaatgacaaaggggaatggaatgggatggtaaaagaactcatcgaccacagagctgacctggcagtggcccctctcaccatcacatacgtacgggagaaagtcattgacttctccaagcccttcatgaccctgggcattagcatcctttaccggaagcccaatggaaccaacccgggtgtcttctccttcctcaaccccctatctccggacatttggatgtacgtgctgctcgcctgcctaggagtcagttgtgtactgtttgtgattgcgaggttcacaccctacgagtggtataacccccacccatgcaaccccgactcagacgtggtggaaaacaatttcactttgctaaatagtttctggtttggagttggagctctcatgcagcaaggatcagagctgatgcccaaggctctatcgaccagaatagttggaggaatatggtggtttttcaccctaatcatcatttcatcctacacggccaacctggctgccttcttgacggtagaaagaatggaatcccccatcgattccgcagacgatctggccaaacaaaccaagatagaatatggggcagtcagagatggctcgacgatgaccttcttcaagaaatcaaagatctccacctatgagaaaatgtgggctttcatgagcagtagacagcagagcgcactggttaaaaacagtgacgaggggatccaaagggtgctcaccaccgactacgcactgctgatggagtccaccagcattgagtatgtgacgcagaggaactgcaacctcactcagatcgggggcctcatagactccaaaggctatggagtggggacgcctatcggctccccttaccgggataaaattacgattgccattcttcaactgcaagaagaagggaagcttcatatgatgaaagagaagtggtggagggggaatggctgccctgaagaagacagtaaggaagccagtgctctgggagtggaaaatatcggcggcatcttcattgttctggctgcaggactcgtgctttctgtgtttgtagccattggagaatttttatacaaatcacggaagaacaatgacgttgagcagtgtctctctttcaatgccatcatggaagagctgggaatatccctcaagaatcagaaaaaattaaagaaaaagtcaagaactaagggcaaatcttctttcacaagtatccttacttgtcaccagagacgaactcagagaaaagagacagtggcgtgatcaaagaacacacctgtaagaagaaaaagcccacacgtccgctgcacatatttggaggacagatttcagaggactatgtctttatccataaccccagtcgtggacagagggggaagaaatgcacaatttttaaagctcacatagatattacttgagaagtgaaactgattcttttcagatgaatttgtatgcacacttattttgaatttttccatttcctccgataaattgctatgtgtgctttctaaataataataaacaagcggactttgtttttcat

SEQ ID NO: 102 - DNA, 2107 bp, Rattus rattus
gggctccgcgcaatgggccgagctggaggcgggggcccgggctgggggccgccgccagtgctgctgcttctgggggtcacgctggtgctcaccgctggggctgtaccggcacgggaagcaggcagtgcgatcgaggctgaagagctggtgaggagcggccttgcatgggagtcgcgtgccaatgacacgcgggaggaagctggcctgccagcagcaggggaagatgagacctcgtggacagagcggggcagtgagctggctgcggtgggccctggggtcgggccagaggagacactagaggcatcggctgcagtgactgggactgcctggctagaggcagatggcacaggcctgggtggagtgactgcagaggctggtagtggcgacgcccagacccttccagctacactccaggctcctgacgaggcccttgggtcatctacaatgccccctgccatccctgaggctactgaagccagtggacctccctcccccaccctccgtgataaacctagcctagtccctgaactccctaaggagatccccttggaagtttggctgaacctgggaggcagcacacctgaccctcaaaggccagagcctacttttccccttcagggcactctagagacacaaccagcctcagatataattgacattgattactttgaaggattggatagcgagggccgaggcacagacatgggcaggttcccgggctcaccaggaacctcagaaaatcaccctgatactgaaggagagaccccctcctggagcctgcttgacttatatgatgacttcacccctttgatgagtctgatttctaccccaccacatccttctatgatgacttggaagaggaggaagaggaggaggaggataaggatgcagtgggaggcggagacctggaagatgaaagtgacctcctcctgccctctcagaagcctggtgtggggccctgggacgggacagcccaccagtcgatggcatgcagttcctccacagcatactctggggatggtacctggtggcagcatctctcttaggccccgccctggagatccaggcaaggacctggccacgagcgaaaatggaacagagtgccgagttggctttgtcagacacaatggctcctgtcggtcagtctgtgacctcttcccgagttactgtcacaatggcggccaatgctacctggtggagaacataggggctttctgcaggtgtaacacccaggactatatctggcacaaggggatgcgctgtgagtccatcatcaccgacttccaggtgatgtgcgtggccgtcggctcggctgcgttggtgctgctccttctgttcatgatgactgtgttctttgccaagaaactctatctgctcaagactgagaacaccaagctgaggaggaccaacaaattccggaccccatctgagctccacaatgataacttctccctctccaccattgccgagggctcccatccaaatgatgaccccagcgctccccacaaaatccaggaagctctcaagtcccgcctgaaggaggaagagtcctttaacatccagaactccatgtcacccaaactcgagggtggcaaaggtgaccagggatacttggaggtgaactttctccagaataacctgacctgagacggaggagggagaggggagaggggggtgggggagggaaggaccgtggtctcctctcgggcagccggctcctcataaccatttgttaagcttttcctttgctgatctcatggcatgctctgatgtgttttgtaggagggggaaactcttaaaataagcaaagaaaccgagcagggttgcgtacattggatggttctcgtctgtgctctttgtacgttgcttctacagctgtgatttctaagcctatgctggcactcagctgacttgtttttttggttttttggtttttgttttttctgggtttttgttttgttttgttttgttttgtttctttgttttttggtttggtttttttttgtttgtttgtttttgtttttttgtactttgacccacctttttttggaataccagtttaaaaaaacaaaacaaacaaggttcttgaaataaaactttttaaaaa

SEQ ID NO: 103 - DNA, 2783 bp, Rattus norvegicus
ctcagcaatggtgactctgtggtggccctgccttgtcttggctctgctctctggcttggagacctctggctttccaaggagtcccctccggctgcttgggaaacggagccttccagaaggggtggtggatggcattgagatctacagcaccaagatcagctgcaaggtgacctcccgctttgctcacaatgttgtcaccacaagggctgtcaaccgtgcagacaaggccaaggaagtttcctttgatgtggaactgcccaagacagccttcatcaccaacttcaccttgactattgatggtgtcacctaccctgggagtgtcaaggagaaggaagttgcgcagaaacaatatgaaaaggctgtgtcccagggcaagacagccggtttggtcaaggcctccgggaggaagctggagaagttcacagtgtctgtcaatgtggccgcaggcagcaaggtcatctttgagctgacctatgaagagctgctcaagagaaacaagggaaagtacgagatgtaccttaaggtccagcccaagcagctcgtcagacactttgagatcgacgcacacatttttgagccacagggcatcagcatgttggacgccgatgcctcatttatcactaatgacctcctgggaagtgccctcaccaagtccttctcagggaaaaaggggcatgtgtctttcaagcccagcttagaccagcagcgctcatgcccaacctgtacggactcccttctcaacggggacttcaccatcgtctatgatgtgaacagagagtctccaggaaatgtgcagatagtcaatggctacttcgtgcacttctttgcaccccaaggcctcccagtggtgcctaagaacatagcctttgtgattgacgtcagtggctccatgtctggtcggaaaatccagcagaccagggaagcccttctcaaaatcctggatgatatgaaggaagaggactatctgaatttcatcctcttcagcactggtgtgaccacctggaaagatcacctagtcaaggccacacctgcaaacctcgaggaggccagggcgtttgtgaagaacatccgtgatcgaagcatgaccaacatcaatgacgggctgctgaggggtattgaaatgctgaacaaggcccgagaagaccaccttgtcccggagaggagcacctccatcctcgtcatgttgacagatggggatgctaatactggcgagagcagacctgaaaagatccaggaaaacgtccggaacgccatcaggggcaagttccctttgtataacctgggttttggcaacaatctgaattataatttcctggagtctctggccctggagaaccacgggtttgcccggcgtatttatgaagattctgatgccagcttacagctgcagggcttctacgaggaagtagctaatcccttgttgactaatgtggagttagaataccctgagaatgccatcctggacctcaccagaaacagttacccccacttctatgatggctctgagattgttgtagcagggcgtctggtggacaggaacgtggacaacttcaaagcagatgtgaagggtcatggggccctgaatgacctgaccttcacagaggaggtagacatgaaggaaatggacgcggccctgaaggagcaaggctacatctttggggactacattgagcggctctgggcctacctcactattgagcagttactggagaaacgcaagaatgcccgtggggatgagaaggagaacatcacagcagaggccctggagctgtccctcaagtaccactttgtaactccactgacctccatggtggtgaccaagcctgaggacaacgaggaccaaacagccattgctgacaagcctggggaagaagccatctctgcgtccacggcctacctgaccagtcagcagtccagccatagcccctactattatgtggatggggacccccacttcatcatccaagtcccgggaaaaaatgacaccatctgcttcaacatcgatgagaagcctggcacggtgctgagccttattcaagacccagtcacaggcatcgcagtgaccgggcagatcattggagagaagggaaataatgcttcttccaggacagggaaaacttactttggcaaactgggcattgccaatgcttggatggactttcggattgaggtgaccacggagaagatcatcctggggaacggggatgcactgagcacgttcagttggctagacaccgtcacggtcacacagacagggctgtctgtgacaatcaacaggaaaaagaatatggtggtgtccttcgaagatgggattagctttgtgatcgtcctacaccaggtttggaagaaacatccggttcaccaggacttcctagggttctacgtggtggacagtcaccggatgtcagcacagacacatgggctgctgggccagttcttccaaccctttgactttaaagtgtttgacgtccgcccaggctctgaccccatgaagccagacgccacaatggtggtgaagagtcatcggttgacagtcacaaggggctcccaaaaagattacaggaaggatgccagtgtcggcaccaaggtcgtctgctggtttgtccataacaatggggaagggttcatcgacggtgtccacaccgactatattgtccccagcttgttctgagtacacatgccagctgctgctgcagtagaaggcctggaacaggacacagaatggggctcgtgggaaggactgggacaataaagtgggtaaaccaaaaaaaaaaaaaaaaaaa

SEQ ID NO: 104 - DNA, 3036 bp, Rattus norvegicus
ccgcctccggctcctcgctcggcccctctccgcctcatgtgccggatagcgggagggccgcggaccctgctgccgcttctggcggccttgcttcaggcatctctggaggcttctggtgaacttgcattatgcaagactggatttcctgaagatgtttacagcgcagtcttaccgaagacagtgcacgaaggccagcctcttctcaatgtgaaattcagcaactgcaatagaaaaaggaaagttcagtatgaaagcagtgaaccagcagattttaaggtggatgaggacggcacagtgtacgctgtgagaagcttccctctctctgcagagcaggcaaagttcctgatatatgcccaagacaaagaaacccaggaaaagtggcaggtagctgttaacctgagcctggagcccagcctgactgaggagccgatgaaggaaccacatgaaattgaagaaatagtattccctagacaactcgccaagcacagcggagctctacaaaggcagaagagagactgggtcatccctccgatcaacttgccagaaaactccagaggaccctttccgcaagagcttgtcagaatcaggtctgatagagataagaacctatctctgagatacagtgtcactgggccaggagctgaccagcctccaacgggcatcttcatcatcaaccccatctctggacaactgtcagtcacaaagcctctggacagagaactgatagcccggtttcacctgagggcacatgcagttgacatcaatggcaatcaagtggagaaccccattgacatcgtcatcaatgtcatcgacatgaatgataacagacctgagtttctgcaccaggtttggaatgggtctgttccagagggatcaaagcctgggacgtatgtgatgactgtcactgccattgatgcagatgacccaaatgccctgaatgggatgctgaggtacaggatcctctcccaggcacccagcaccccttctcccaacatgtttacaatcaacaacgagaccggggacatcatcactgtggcagctggtctggaccgagagaaagtgcaacagtatacgttaataattcaagccactgacatggaaggcaatcccacttacggcctttcaaacacagccacagccgtcatcacagtgacagatgtcaatgacaatcctccagagtttactgccatgactttctacggagaagtccctgagaacagagtggatgtcattgtagccaacctgactgtcaccgacaaggaccagccccacacaccagcctggaatgcggcatacagaatcagtggtggagaccccacgggaaggttcgccatcctgacagaccccaacagcaatgatgggctagtcacagtggtaaaaccaattgactttgaaacgaataggatgtttgtccttactgttgctgcagaaaaccaagtgccattagctaaggggatccagcacccacctcagtcgacagccacggtgtctgtgacagttattgatgtcaatgaaaatccttattttgccccaaatcctaaaatcattcgccaagaggaaggcctccacgcaggtaccatgctgaccactctcactgctcaggaccccgatcgatatatgcaacagaatatcagatacacaaagttatctgaccctgccaactggctgaaaatagaccctgtgaacgggcagatcaccactatcgctgttctggacagagagtcgccaaatgtcaaaaacaacatctataatgctaccttccttgcttctgacaatggaatccctcctatgagtggaacaggaacgctgcaaatctatttacttgatatcaatgacaacgcccctcaggtgttacctcaagaggccgagacttgtgaaactccagaacccaattcaattaacatcacagcgcttgattatgacatagaccccaatgcagggccctttgcatttgaccttcccttatccccagcgaccattaaaagaaactggaccatcacccggcttaatggtgattttgctcagctcaatttaaagatcaagtttttggaagctggcatctatgaagttcccatcgttatcacagattcagggaatccccccaagtccaatatttccatcctgcgtgtgaaagtttgccaatgtgactccaatggagactgcaccgacgtagacaggatcgtgggtgcagggcttggcacgggcaccatcatcgcgatacttctgtgtatcatcatcctgctgatccttgtcctcatgttcgtggtatggatgaaacgccgggataaagagcgccaggccaagcagcttttaatagacccagaagatgatgtaagagataacatattgaaatatgatgaagaaggtggaggagaggaagaccaggactatgacttgagccagctccagcaaccagataccgtggagcctgatgccatcaaacctgtgggaatcagacggctagacgagaggcctatccacgctgagccacagtatccagtccgatccgcagccccacaccctggggatattggggacttcattaatgagggccttaaagctgctgacaatgaccccacggcgccaccatatgactccctcttagtcttcgactatgagggcagcggctccacggctggctccttgagctctctcaactcctccagcagcggcggggaccaggactatgactacctgaatgactggggaccccgcttcaagaagctggccgacatgtatggtggtggtgatgactgaacggcaggacggacttggcttttggacacgtatgaacagtttcacctgatattcccaaaaagcatacagaagctaggctttaactctgtagtccactagcaccgtgcttgctggaggctttggcgtaggctgcgaaccagtttgggctcccagggaatatcagtgatccgatactgtctggaaaacaccgagctcagctacacttgaattttacagtacagaagcactgggattttatgtgcctttttgtacctttttcagattggaattagttttctg

SEQ ID NO: 105 - DNA, 1247 bp, Rattus norvegicus
aagaacattttctgtctttttaatgtcagggtcttctgaacctagatcaactcggggttccagtcagacacctagttctgacatcttggtggtcacagctctcctctgggactccacaaagagttaatgtccctggggctcagcccaggaagattccagcctctgcccaggcccaagatagttgctggctcaattcccctggcatgcaagactggagaggaggaggggcccaccagcagctgcttgggattccagaccctgtcctggctccagagaacaaggatggggtgggtgggtgccactaggtgtggacagagagctagtgaaacaagaccgtgacaagtcaccggccagctcagccctgccccgtgtttctcttttcttagctcagtgagtactgggtatgtgtcaccctgccaaatccctgatcacaagtccccatgaactgtcggggagctgggataataaaacccctgacatcaccgttccagaagcttcacaagactgcatatataaggggcaggctgtagcagcggctgaaggagttgaccggctaaccgactctacactcatctagccatcatggacatagccatccaccacccctggatccggcgtcccttctttcctttccactccccaagccgcctctttgaccagttcttcggagagcacctgttggagtctgacctcttctctacagccacttccctgagccccttctaccttcggccaccctccttcctgcgggcacctagctggattgacactgggctctcagagatgcgtatggagaaggacaggttctctgtgaacctggacgtgaagcacttctctccagaggaactcaaagtcaaggttctgggagacgtgattgaggtgcacggcaagcacgaagagcgccaggacgaacatggcttcatctccagggagttccacaggaagtaccggatcccagccgacgtggatcctctcaccattacttcttccctgtcatcggatggagtcctcactgtgaatggaccaaggaaacaggcctctggccctgagcgcaccattcccatcacccgtgaagagaagcctgctgtcactgcagcccctaagaagtagattccctttcctcgttgcattttttaagacaaggaagtttcccatcagcgaatgaacatctgtgactagtgccgaagcttactaatgctaagggctggcccagattattaagctaataaaaaatatcgttcagcaac

SEQ ID NO: 106 - DNA, 2486 bp, Rattus norvegicus
tgagagcgagacaagctgggaatgaagtcctggttgccagatgggagcttgaaaacacagtaagatgagtcaaaaagtggccaaggagggccccaggctctccaagaaccagaagttctcagagcacttcagcatccactgctgcccacccttcaccttcctcaactccaagcgtgagatcgtggaccgcaagtacagcatctgcaagagcggttgcttttaccagaagaaggaggaggactggatctgctgtgcctgccagaagaccaggactgtgtgaatcaggctcaggcaatcttacactcatctctctagagcccagctcagggtttggctgacgtcggcgactgaatgagaccagataatttacctcacagtctgacccagcaagaaagtcagattgagaaggaggagcaggtcaaccccaagaaaaaagtgaccgagaagggacttctcgtgaatggacagcctctgcttgtggatttactgcttcaccgcaacccatctgccctcagacttatctggcctcgagtatgacgcaggggtggacacctgctgatataacaactacagatgccctcagtccccatggtgtgggagccttagggcagcctgcctggagcacttggacgatgccactccatcacctccctctataaccgccgaagaggcatctctgtccaccttctgaccctccatggttgttcagtctgaagattcctgtgtcttcagggatgtgcaaaacaaggtcatggtgtgcgaccatccaaatggcaaatataaaaaagaaattgtcaagtgttggcggtgacgcaagaaaaatcctagaagccacagatggggatttatacactgtcgcaacaccgttgagatgtactctggggacactatcaaggcaaagtatcttaaaacctctaatcaagcgactgtaattttaggcatccatcctggggaaaactcacacccttttagagaaaggagaaatgcccaaatttgtttaaaagatcgtggtttgtagttaagagaggtagaatgagattaaccaaaatgtcggtccacgggagagcaagagagtcaatcttggtatgtccacaaagtcctaagagcagttaaaagccaatctgtcagacagacccatgccgagcaggtaaatctagaaagcaaaccaaggactataaaagtcaagcaccaggcagtaaatccagaataagagcctatgcatacatattgacagctacaatcctgtactggttattgcttacataaggagaagccacagatctattctttcttctagaatgcaatagaatttaaaaatgacagcagaacaaaaggacactagaaattatcctctcagaaataaaagtataagaaataatttctggcttgaggaaataacccaggctaaaagctacacaggcctggcttaaccataccagcagggcatacctttgttaggagagggtcaattcgaagtttgtgaacagcctgggctgtttccgaggctgcataaatcttaaacaccaaaaatgtgtgttttgaattaactttgggtctggtctacagagtccggcttgtgatggctcctgacacgggagaaaaggggataagttaatataaggctctgggattttcctttgaggaacaggcaggtaggaaaggacactagaatgttggggaatgtggagggatgtaaaacagacagtattatgatggggggaactcaggaaggaacggtaaggacaccagaatggcctcgtgctgggagccagggtggccaagcccaggcagatgcacaaagaccccaaaggccaccattgcctcacaaccagacccagcaaagttcagatcaagtgcataaatgggggtcacgtcagtggaaactgtccggagcatggagcagggggtgaggaagacagtcagaaggaagcaagagatggcttagagtgttgcatggcagcaagaagaagcagtccaaatatcatcccaaggcagccatggcttcctctcccgaggacactgtggccctgtggaagtgccaaggcagaggcagaggaatttaaccgcacacaaactacatgcagaaactaaggtgctaaatgaacatctacgtgacaacctttctgaggaccaggttccagtgagcggcccagggccgttatcttcgcgatggtaactgagctgagaagaatgggaaccggataggagcacacagtagcccactggtgagacaaatccacgggcgagcctcaaccaacccactaaggaaacttcacgccttttcatctagttttcattttggcaaagcaaagccatcctgagtgcttgcttgtctccgccctccacgccacccccgagacacagagcatgcgcattaacccagagcgcgctaacacatgcacagcgttggacattagcctattaatgggaataaccagaaactactaaattttgtttgttgtagaaataaaacctggggatggatc

SEQ ID NO: 107 - DNA, 1015 bp, Rattus norvegicus
atcgcactgtgcagcggccagagacaccgtgcagtgcctgtgtgtggtaaaatccaacccggaaccctccgtggcctttgagctgccttcccgcaacgtgactgtgaacgagacagagagggagtttgtgtactcagagcgcagcggcctcctgctcaccagcatcctcacgctccggggtcaggcccaagccccaccccgcgtcatttgtacctccaggaacctctacggcacccagagcctcgagctgcctttccagggagcacaccgactgatgtgggccaaaatcggccctgtgggtgctgtggtcgcctttgccatcctgattgccattgtctgctacatcacccagacaagaagaaaaaagaacgtcacagagagccccagcttctcagcgggagacaaccctcatgtcctgtacagccccgaattccgaatctctggagcacctgataagtatgagtccagagaggtctctacccgggattgtcactgagagccccaggagagtgagaagcgcctggggtccgagaggaggctgctgggccttaggggggaacccccagaactggacctcagttattcccactcagacctggggaaacgacccaccaaggacagctacaccctgacagaggagctggctgagtacgcagaaatccgagtcaagtgaggaagctgggggctggccctgtggctcaccccccatcaggaccctcgcttggcccccactggccgtgggctccctttctcttgagagtggtaggggtgggggcgggaaggggcggggcaggaaacagtgaggtcttaggggcccggcctcccctccttcccggctgctcctctctgccaacatcctgcacctatgttacagctccctctcccctccttttaacctcagctgttgagaggggtgctctgtctgtccatgttatttattgttatcctggtctcctgtccccttacccggccccaggacctgtacaaaagggacatgaaataaatgtcctaatga

SEQ ID NO: 108 - DNA, 1736 bp, Rattus rattus
gggggaagccagcaacctagaggacgcccccgagtttgtgcctgaggctactccgctctgagccggctgtccctttgaactgaaagcaccgctccaccgagcccgagcccaactccagccaccatgcttctactcttgttggggatcctgttccttcacatcgcggtgctagtgttgctcttcgtctccaccatcgtcagccaatggctcgtgggcaatggacacaggactgatctctggcagaactgtaccacatccgccttgggagccgtccagcactgctactcctcatctgtgagcgaatggcttcagtctgtccaggccaccatgatcctgtctgtcatcttcagcgtcctgtccctgttcctgttcttctgccagctcttcactctcaccaaaggcggccgcttttacatcactggagtcttccaaatccttgctggtctgtgtgtgatgagtgcagcggccatctacacagtgagacacagtgagtggcatgtcaacaacgactactcctatggctttgcttacatcctggcctgggtggctttcccgctggccctccttagtggcatcatctacgtgatcctgcggaaacgcgaatgaggcgcccgacgcaccatccgtctaggctctgagcgtgcatagggtacacagggagggaggaaggaaaccagaaaaccaaaccaaccaacccaaaagagctagcccccaaacccaaacgcaagccaaaccaaacagaacacagttgagtggggattgctgtcgattgaagatgtatataatatctatggtttataaaacctatttataacactttttacatacatgtacataggattgtttgctttttatgttgaccgtcagcctcgtgttgaatcttaaacgactctacatcctaacactataaccaagctcagtattttcgttttgtttcgtttttttcatcttttgttttgctcagacataaaaaaaaaaaaaaaaatccacgtggccccctttcatctgaaagcagatccctccctcccattcaacctcataggataaccaaagtgcggggacaaaccccagatggccagaggccttcacactatgggtgacccagtgaatttagcaggaataatccgctgcccgaatcaatgtgtgaagccctaagcactcacagacgaaacgccctgaccagagccctctgcgaaaccaatagctggtggctgcggaacacttgaccctgaaggcggagtactggggcacatgtttaaatgagacgtcagagacaagcaatctgtgaaatggtgctatagatttaccattccttgttattactaatcatttaaaccactcactggaaactcaattaacagttttatgacctacagcagaacagagacccgatacaaacggttcgtaactgctttcgtacatagctaggctgttgttattactacaataaataaatctcaaagccttcgtcactcccacagttttctcacggtcggagcatcaggacgagggtctagacccttgggactagcaaattccctggctttctgggtctagagtgttctgtgcctccaaggactgtctagcgatgacttgtattggccaccaactgtagatgtatatacggtgtccttctgatgctaagactccagacctttcttggttttgctggctttttctgattttataccaactgtgtggactaagatgcattaaaataaacatcagagtaactc

SEQ ID NO: 109 - DNA, 2468 bp, Rattus norvegicus
cagaagccagaccatccaaggttgactggccacttggagcggaatcaggagacattcccaactcagggagactgaggtgagggccctagctcgcccacttgctggacaagatgatattccttaccaccctgcctctgttttggataatgatttcagcttctcgaggggggcactggggtgcctggatgccctcgtccatctcagccttcgagggcacgtgtgtctccatcccctgccgtttcgacttcccggatgagctcagaccggctgtggtacatggcgtctggtatttcaacagtccctaccccaagaactacccgccagtggtcttcaagtcccgcacacaagtggtccacgagagcttccagggccgtagccgcctgttgggagacctgggcctacgaaactgcaccctgcttctcagcacgctgagccctgagctgggagggaaatactatttccgaggtgacctgggcggctacaaccagtacaccttctcggagcacagcgtcctggacatcatcaacacccccaacatcgtggtgcccccagaagtggtggcaggaacggaagtagaggtcagctgcatggtgccggacaactgcccagagctgcgccctgagctgagctggctgggccacgaggggctaggggagcccactgttctgggtcggctgcgggaggatgaaggcacctgggtgcaggtgtcactgctacacttcgtgcctactagagaggccaacggccaccgtctgggctgtcaggctgccttccccaacaccaccttgcagttcgagggttacgccagtctggacgtcaagtaccccccggtgattgtggagatgaattcctctgtggaggccattgagggctcccatgtcagcctgctctgtggggctgacagcaacccgccaccgctgctgacttggatgcgggatgggatggtgttgagggaggcagttgctgagagcctgtacctggatctggaggaggtgaccccagcagaggacggcatctatgcttgcctggcagagaatgcctatggccaggacaaccgcacggtggagctgagcgtcatgtatgcaccttggaagcccacagtgaatgggacggtggtggcggtagagggggagacagtctccatcctgtgttccacacagagcaacccggaccctattctcaccatcttcaaggagaagcagatcctggccacggtcatctatgagagtcagctgcagctggaactccctgcagtgacgcccgaggacgatggggagtactggtgtgtagctgagaaccagtatggccagagagccaccgccttcaacctgtctgtggagtttgctcccataatccttctggaatcgcactgtgcagcggccagagacaccgtgcagtgcctgtgtgtggtaaaatccaacccggaaccctccgtggcctttgagctgccttcccgcaacgtgactgtgaacgagacagagagggagtttgtgtactcagagcgcagcggcctcctgctcaccagcatcctcacgctccggggtcaggcccaagccccaccccgcgtcatttgtacctccaggaacctctacggcacccagagcctcgagctgcctttccagggagcacaccgactgatgtgggccaaaatcggccctgtgggtgctgtggtcgcctttgccatcctgattgccattgtctgctacatcacccagacaagaagaaaaaagaacgtcacagagagccccagcttctcagcgggagacaaccctcatgtcctgtacagccccgaattccgaatctctggagcacctgataagtatgagtccagagaggtctctacccgggattgtcactgagagccccaggagagtgagaagcgcctggggtccgagaggaggctgctgggccttaggggggaacccccagaactggacctcagttattcccactcagacctggggaaacgacccaccaaggacagctacaccctgacagaggagctggctgagtacgcagaaatccgagtcaagtgaggaagctgggggctggccctgtggctcaccccccatcaggaccctcgcttggcccccactggccgtgggctccctttctcttgagagtggtaggggtgggggcgggaaggggcggggcaggaaacagtgaggtcttaggggcccggcctcccctccttcccggctgctcctctctgccaacatcctgcacctatgttacagctccctctcccctccttttaacctcagctgttgagaggggtgctctgtctgtccatgttatttattgttatcctggtctcctgtccccttacccggccccaggacctgtacaaaagggacatgaaataaatgtcctaatgacaagtgccagtctagacccatcctttggaggaaaggggcatattagtaatacttttctcgttgctgtaacaaaatactggacaaaaacac

SEQ ID NO: 110 - DNA, 1362 bp, Rattus norvegicus
ggcacgaggcactgggctgtaatggggctgcctggctccccttggcagtgggtgctgttgctgttggggctactgctccctcctgccacctccttctggctcctcaatgtgctcttccccccgcacaccacgcccaaggctgaactcagtaaccacacacggcctgtcatcctcgtgcctggctgcatggggaaccggctagaagccaagctggataaaccaaatgtggtaaactggctgtgctaccgaaagacagaggacttttttaccatctggctggatttcaacatgtttctacccctcggggtggactgctggattgataacaccagggttgtctacaaccgaagctctgggcacatgtccaatgcccctggtgtacagatccgtgtccctggctttggcaagacctactctgttgaatacttggatgacaacaagctagcaggctacctgaacacactggtgcagaatctggttaacaatgggtatgtgcgggatgagacagtgcgggccgcaccctatgactggcgtctggcaccccgccagcaggatgaatactaccagaagctggcaggactggtagaggagatgtatgctgcttacgggaagcctgttttccttattggacacagccttggctgcctacatgtgctccatttcttactgcgtcagccacagtcctggaaggaccacttcattgatggcttcatctctctcggggccccatggggcggttccatcaagcccatgcggatcctggcctcaggtgacaaccagggcatcccgatcatgtccaacataaagctgagagaagaacagcgcataaccacaacttccccctggatgtttccagctcaccacgtgtggcctgaagaccacgtgttcatttccacaccaaacttcaactacacaggccaagacttcgagcgtttttttgcagatcttcattttgaagaaggctggcacatgtttctacagtctcgtgacctactagcaggcctcccagcgcctggtgtagaagtatattgtctatacggtgtaggcatgcccacagcccacacctacatctatgaccacaactttccctacaaagacccggtggctgcactctatgaagatggggacgacactgtagccacacgtagcactgagctctgtggccaggtgcagggccgccagtcacagggtgtacacttgctccgcatgaatgggacagatcatctcaacatggtcttcagcaataagacactggagcatattaatgctatcctactgggtgcctacccgcatggcactcctaagtccccaaccgccagcctaggtcccccaccaacggaataaagacttactgttatgaaa

SEQ ID NO: 111 - DNA, 2480 bp, Rattus norvegicus
gaattcggcacgagtagactcatggcttcgcctctgaggttcgacgggcgtgtggtcctggtcaccggcgccgggggagggttgggcagagcttatgccctggcttttgcagaaagaggagcattagttgttgtgaatgacttaggaggggacttcaaaggcgttgggaaaggctcttctgccgcagacaaggtcgtggaagaaataagaaggagaggcgggaaagcggtggccaattacgattcagtcgaagcaggcgagaagcttgtgaagacagcactggacacattcggcagaatagatgttgtggtgaacaatgctgggatcctgagggaccgttccttctctaggataagtgatgaagactgggatataattcaaagagttcatttgcggggctccttccaagtgacccgggcagcatgggatcatatgaagaagcagaattatggaagaatcattatgacggcctcagcttctggaatatacggcaactttggccaggcaaattatagtgctgcaaagctgggccttctgggtctcgccaatactctcgtgattgaaggcaggaagaacaacattcattgtaacaccattgccccaaacgctgggtcacggatgacagagacggtgatgccagaagacctcgttgaagccctgaagccagagtatgtggcaccgctggtcctttggctttgccatgagagctgtgaggaaaatggtggcttgtttgaggttggagcaggatggattggaaaattgcgctgggagaggaccctgggagccattgtcaggaagcggaatcagcccatgactcccgaggcagtgagggacaactgggtgaagatctgtgacttcagcaatgccagcaagccgaagagcattcaagagtccacaggtggtataatcgaagttttacataaaatagattcagaaggaatctcacaaaatcacaccggtcaagtggcatctgcagatgcatcaggatttgctggcgtcgttggccacaaacttccttcattttcttcttcatatacggaactgcagtgcattatgtatgccctcggagtaggagcttcagtcaaaaatccaaaggacttgaagtttgtttatgaagggagtgctgacttctcctgtttgcctacatttggagtcattgtcgctcagaagtccttgatgagtggaggcttagcagaggttcctgggctgtcaatcaactttgcaaaggttcttcatggggagcagtacttggagttgtataagccacttccccgatcaggggaattaaaatgtgaagcagttattgctgacatcctggataaaggctctggcatagtgattgttatggacgtctattcttattctggcaaggaacttatatgctataatcagttctctgtcttcgttgttggctctggaggctttggtggaaaacggacatcagaaaaactcaaagcagctgtagccgtaccaagtcggcctccagatgctgtactgagagataccacttcactgaatcaggccgctctgtaccgcctcagtggagactcgaatcctttacacattgacccgagctttgcgagcattgccggttttgagaaacccatattacacggattatgtacttttgggttttctgcaaggcatgttttacagcagtttgcggataatgatgtgtcaagattcaaggccattaaggttcgttttgccaaaccagtgtatccaggacaaactctacaaactgagatgtggaaggaaggaaacagaattcattttcaaaccaaggtccaagagactggagacattgtcatttccaatgcatatgtggatcttgttcctacatctggagtttccgctcagacaccttctgagggtggagcactgcagagtgctcttgtatttggggaaataggtcgacgcctcaaggatgttggacgtgaggtggtaaagaaagtaaatgctgtatttgaatggcatatcacgaaaaatgggaatgttgcagccaagtggaccattgacctgaagaacggctctggagaggtttaccaaggccctgccaaaggctctgctgacacgaccatcacaatttctgatgaggatttcatggaagtggtcctgggcaagcttaacccacagaatgccttcttcagtggcagactgaaggcccgaggaaacatcatgctgagccagaagctacagatgattctgaaagactatgccaagctctgaaggacccactgcgtgctttaataaaaccagaatcattacgttctgtctacgcagtcatgctccagccttctttgaaacgatccacggtaatgtgcagcagaaattgcttaacattttcagattcagataactttcagattttcattttctactaatttttcacatattatttttacaaggaactgtaatctagctagcaaataattgttctgttcatagatctgtatcttaataaaaaaaaaaaaaaaaaa

SEQ ID NO: 112 - DNA, 2472 bp, Rattus norvegicus
ggcaacaccgcgacctctgaacccgtgcctcagagacaacaccgcgaccctctggcgacctctgaccctgtgaccctgtgtggtgtgacctcacgaccctggcgccctcagcggtgacctttgaccccgcagcgaccccgagaccccaggacccctgcacttatccacaactctgggacctccaaccccgcgaccccaacagcgacctctgaccctggtgaaagcaggagaacccgggacaccagtgaccctgcaacttctgaccccactaagggcaacaactctgagactgtacggtgacctctgacctctgaccctgggctgttcccccgagataacagtgaccccaggaactccaactcagctacaacctggtgacaaccaaggtaacccagggacaacctctgaccccttgaatccacgacttttcacccagtgctgaccactgcagtgtggggcagtctgagagagtgcgtgacctttgatctctgacctctgaccccgacccagccttgcccacaggacgatgctctggccctgtctccttgccctgctcctctcccagctcaactttctctgtgctgcccgtcctggccctggacctaacttcctgctcatcatggctgatgaccttggcattggggacctaggctgctatggcaaccgcacactcaggacgccacacatcgaccgcctggcccttgagggggtgaagttgactcagcacctggcggctgcgcccctgtgcaccccgagccgcgctgccttccttaccgggcgctaccctgtgcggtcagggatggcatcacatggccgcctgggtgtattcctgttctcggcatcatctggggggctcccgcccaatgaagtcacctttgcaaagttgctcaagggtcaaggctacaccaccgggcttgtagggaagtggcatctggggctgagctgccaagcagcctctgacttctgccaccaccctgggcgccatggctttgaccgcttcctgggcacgcccaccaccaacctgagggactgcaagccagggggcgggaccgtgtttggctctgcccaacaagtattcgtggtcctgcccatgaatattctgggggcagtgctgctggccatggcacttgcgcggtgggcagggctggcccggcccccagggtgggtgttcggggtgacagtggctgccatggcggcggtgggcggggcctatgtggccttcctctaccacttccgcccagccaactgcttcctcatggccgacttcaccatcacccaacagcccacggactacaaggggctcacacagcgcctggcaagcgaggctggggacttcctgcgcaggaacagggacacgcccttcctgctattcctgtctttcatgcatgtgcacacggcacacttcgccaaccctgagtttgccgggcagagcctgcatggggcctatggagatgctgtggaggagatggactgggccgtaggccaggtccttgccacactggacaagctgggcctcgccaacaacacactcgtgtacttgacgtccgaccatggcgcacacgtggaggagcttggccccaacggtgaacggcatggcgggagcaacggaatttacaggggcgggaaggccaacacgtgggagggtggcatccgtgtgcctggacttgtgcgctggcccggcgtgattgtgcccggccaggaggtcgaggagcccacgagcaacatggacgtcttccccactgtggccaggcttgcaggggcagagctgccgactgacagggtgattgacgggcgtgacttgatgcccctgctgctgggccatgtacaacactctgagcatgaattcctgttccactactgcaatgcctacctcagcgctgtggcatggcggccccacaacagctcgtccgtgtggaaggcgttttacttcacaccgaacttcgaccccccgggctctaatggctgcttctccacacacgtgtgcatgtgccacggccaccatgtcacgcaccatgatccgcccctgctcttcgacattgcccgtgaccccagggagcgccacccgctcacgcctgaaacagagccgcgccatggtgagatcctgcgcaacatggatgctgcggcccgtgcacacgttgctaccctagaggaggcgcccaatcagctttccatgtcaaatgtcgcatggaagccatggctgcagctctgcctgccttccaagccccacccactcgcatgccgctgtgctggcgacgggtgagttgggcatgccaaacacacaggtatgcaagcatgggacactgtggcctggtgatttcacctcctgaactgatacctgacacaatcttgctgacatgtatgaaaacatatgaacatgtatgaacatgtgtatgctgagtacaaaacacaggaagagcccctcagcatgaccctgatgaataaatgatgtggacacggaaaaaaaaaaaaaaa

SEQ ID NO: 113 - DNA, 847 bp, Rattus norvegicus
ctcgcaggattctcctgtggaaactgccttcatcgtatctgagaggcctctcctgcagccgccaaccccaagatggcgaccatgctgttgctcctggccacactggcaggtctcttcaccacaaccgaaggacaaagcttccatcttgggaaatgcccatctcctccggtgcaagagaatttcgatgtgaaaaagtatcttggaagatggtacgaaatcgagaagatcccggtgagctttgagaaaggaaactgcattcaagccaactactcgctgatggagaacggaaacatcaaagtgctaaacaaggagctgcgtcctgacggaaccctgaaccaagttgagggtgaagccaaacagagcaacatgtcagagccagccaagctggaagtccagttcttctcgttgatgccaccggcaccctactggatcctggccacggattacgagagctatgccctcgtgtattcctgcaccaccttcttctggttcttccacgtggactatgtttggatcctgggaagaaatccttacctccctccagaaacaataacctacctaaaatatatccttacttctaatgacatcgacatcgccaaaataacaacaaaagaccaagcaaactgcccggacttcctgtaaaggggggtgggcaaccgctccaggttatttcttcgctttggctccctggccccacccccactcctcatcaggaccgagcaaccccgccagcactagagggaaagtattgctatagaagccaatggaggggactgatgggaaggtggcccaaacccaagaccccacattgttactcgccagcccaataataaacattttgctgatc

SEQ ID NO: 114 - DNA, 4377 bp, Rattus norvegicus
agtcggtcgactccgagctcagtgaggacctaaagcagaggactgtggtgcggaggacagtgcttgctccggggagtgcagagcaataggtccccactcaagatggcagaggctcaccaagctgtggccttccagttcaccgtcacccccgatggcattgacctccgcctgagccacgaagccctcaaacagatctgcctgtcggggctgcactcctggaagaagaagttcatccggttcaagaatggcatcatcactggtgtgttccccgcgaatccgtccagctggcttatcgtggtggtgggtgtgatttcatccatgcatgccaaagtggacccctccctgggcatgatcgcaaagatcagtcggaccctagacaccactggccgcatgtcaagccagacgaagaacattgtgagcggcgtcctctttggtacagggctctgggtggcagtcatcatgaccatgcgctactcgctgaaggtgctgctctcctaccacggctggatgtttgcagaacacggcaaaatgagccgcagcaccaagatctggatggctatggtcaaggtcctctcaggtcggaagcccatgttgtacagcttccagacgtctctgccacgcctgcctgtcccagctgtcaaagatactgtgagcaggtacctggaatctgtaaggccactgatgaaggaagaagacttccagcgcatgacagcactggcccaggattttgctgtcaacctcggacccaaattgcagtggtatttgaagctaaaatcctggtgggccacaaattacgtgagtgactggtgggaagaatatatctacctgcggggccgagggccgctcatggtcaacagcaactactacgccatggagatgctgtacatcaccccaacccatatccaggcagcgagagctggcaacaccatccacgccatactgctgtatcgtcgcacattagaccgtgaggaactcaaacccattcgtcttctgggatccaccattccactctgctcagcccagtgggagcgactcttcaatacttcccggatccctggggaggagacagacaccatccaacatatcaaggacagcaggcacattgttgtgtaccacagagggcggtacttcaaggtctggctctaccacgatgggaggctgctgaggccccgagagctggagcagcagatgcagcagatcctggatgatccctcagagccacagcctggggaggccaagctggccgccctcactgctgcagacagagtgccctgggcaaagtgtcggcagacctattttgcacgagggaaaaataagcagtccctggatgcggtggaaaaggcagcgttcttcgtgacgttggacgaatcggagcagggatacagagaggaggatcctgaggcatccatcgacagctacgccaaatccctgctgcatggaagatgctttgacaggtggtttgacaagtccatcacctttgttgtcttcaaaaacagcaagataggcataaatgcagagcactcctgggcggacgcgcccatcgtgggccatttgtgggagtatgtcatggccaccgacgtcttccagctgggttactcagaggatggacactgtaaaggagacaccaaccccaacatccctaagcccacaaggctacaatgggacattccaggagagtgccaggaggtcatagatgcatccctgagcagcgccagtcttttggcaaatgatgtggacctgcattccttcccatttgactctttcggcaaaggcttgatcaagaagtgccggacgagtcccgatgccttcatccagctggcgctgcagctcgcacattacaaggacatgggcaagttctgcctcacatatgaggcctccatgacccggctcttccgagaagggaggacagagactgtacgctcctgcactatggagtcctgcaactttgtgcaggccatgatggaccccaagtcaacggcagagcagaggctcaagctgttcaagatagcttgtgagaagcaccagcacctgtaccgcctcgccatgacgggcgccggcatcgaccgccatctcttctgcctctatgtggtgtccaagtatcttgcagtcgactcacctttcctgaaggaggtattgtctgagccatggaggttgtctacgagccagactcctcagcagcaggtggagctctttgactttgagaaaaaccctgactatgtgtcctgtggagggggctttgggccggttgccgatgacggctatggtgtctcctacattatagtgggagagaatttcatccacttccatatttcttccaagttctctagccctgagacagactcacaccgctttgggaagcacttgagacaagccatgatggacattatcaccttgtttggcctcaccatcaattctaaaaagtaaacccctgagccacacggaaggaaaacggaccctcgtgatacaaaccaaatgaatagatgttgctcctgaccataggacaggcagaaaattgctcttataaaactcagttttccttccagaaggtttaccgtcagtctccctagaacaacagtaggcttcacgtgtgaattgtgaccctactacatccagagatgccttggctccaggaatattgggcacagtcccctgatgtcttttgaatcggctcctactggataaagggatttaaatgctggtgaattcctggattctgggggttgtttcttcacatgtgttggaggtgacagacttcctcagtggtgaccctgtgaatacttgggcgtctgactccacccaggcagtgtgagcatcaccttgtggaaagagaaagtgtcttcagagccagcagaggcaacagctgtagctaacacatctgtaacacactaatggaatggttaggcctggggattaaggttctgctatgagtgacagccactgtccctttggaagttcacatttccaggaagcagagtaccacctccccagtgccaccttcctcacacatcttcaaaacccagtgccttaaagaaggggcccattggcaagcgggaccatagagaagacttagcatctgtgaagcctttgggtggatatgtgaggatgctgcttccccttactggttcctgcataaagatgtccctaagtaagcacttcccccacccctagaaaatgaggtccttggtgaaggcagggatgctggagtctcattgcctgccagttccattaagccacaaaatagcagacatgtgtccacagagggaggggcttggtagtcaaaggctgcatagctggacaacagcgggagagtgtggcttgctgtatttgacagctgttggcaagaggagtgagaccctggtcaccaagtcagacatactgacacaggcagccaaagctcacggagccaggagatatagatagatactggcttgtattctggcagatacacccctgggcttatcttctaatcccacccagtcagattccaaccagagtcaaattccatagaaggctaggtcattttggcgacagactcagggatctcaagtaatgggtgcttttacccacatgccatccctcagtgggagtgcctttcttgaaagcatccaatgggctaaagcagctctaccaagtctgtttggtatttaatgtaaacattagcattaatggagtggtctctcctacctgtcaccatcctgtcctgacaagcttagctctccgaggtttacatcatgtatttattttccagtgcccctttggccttgtttgattcctgcccctgtgccagaagtggcccagaagtgaggggtggggtgaccagcagtgcagagaggtgctggctgaacagttcatgtgtgtcttatgggtatacatgtataaattttgtaatgtaaaaaaaaaaatcatacctaaaagggccaaagttttttttttttttactaaaaccaagaaaacaaaagacaacataaagacataagcagaaacaaactgttgtaagtcagagcggcctgactctcgctgctgtgaccactcaccaacctgtgttactcagagtagcccggctagtgcccgagtgggacattcctctctcaggtttccagtgtccttgctgctcctgagcagttaccaatgcaatttcgcattccttacaaggcagaagagtgggctctcactgtatgtgttcaaaggaggaggtaagactattgtgtatttaatttaatgtggaacaaaatatagtcttaccgcagccaaggttcaaatttggtgttctaatctgtccattgcatgtaaataccatatctgtttggatataaatcttagaagtgcatgtgtgagcgaatgtagctggccattaataaaacattaatactgtctact

SEQ ID NO: 115 - DNA, 1307 bp, Rattus norvegicus
gtgcttttgggtttggcgatcagttccgcgggagtcttgtcaggagcaggatggcggcttcgggcgaggcgcgccgagtgctggtgtacggcggcaggggtgctctgggctcgcgctgcgtacaggccttccgggcccgcaactggtgggttgccagcattgatgtggtggagaatgaagaggccagtgccagcgtgattgttaagatgacagattcattcacggagcaggctgaccaggtcactgctgaggtcgggaagctcctaggtgaccagaaggtggatgccattctctgtgtggctggaggatgggccgggggcaatgccaaatccaagtcactctttaaaaactgtgacctgatgtggaagcagagtatttggacatccaccatctctagccacttggccacaaagcacctgaaggaaggaggcctcttgaccctggccggggccaaagctgcgttggatgggactcctgggatgattggctacggcatggccaagggagccgtccatcagctctgccagagccttgcagggaagaacagtggcatgccgtctggggctgccgccattgctgtgcttcccgtcaccctggatactccgatgaacaggaaatcaatgcccgaggcagacttcagctcctggacacccttagagttcctggtggagaccttccatgactggatcactgggaacaaacggccaaactcaggaagcctaatccaggtggtaaccacagacgggaagacagagcttactccagcctatttctaagttgcacctcagtgcccaggagaaccctcttgaaactctactaacctgtgtctgtattgccgcacctggccccatgttgtctgtattcctgtttgtggtacgagataactagtcccgtttgtctcttacgtagtgctccttttttgtcctgggctggtgaggtatgtttatggggaatgagtgggggcctgtaagtagcaccatcagtgctgaggcccagggaggtatgtgtgcaggccgtcatcccagcatcccagactgctttggagacccgtttgatagttcattttttagcatttggggcactttgaaatccaacttgtttttaaattccatgttagtgccatagatgtagtttttgctgcctgaaaattaactgccatgaaaattcattggtgatgtaagtaagcaaaacctaatggactctgttggatatcatttgtgttccagcctaggctaagtgtttatgagaactattcgtgagtgttcggagtgttcttcctaataaacacatttcatgtccccgaattc

SEQ ID NO: 116 - DNA, 1828 bp, Rattus norvegicus
gtggcactccgcagcactacccggagacagctaacagtgcagcccgagtgatctgggaagccgttctcagtgaccgacttttctagtcctgttccacgcgaccagcagagacatgaattactcaaggttcctcactgcaacgagcctggccagaaagacatcccctatcagagctacagtggagataatgagtagagcacccaaagacatcatctccctggctcctggatctccgaacccgaaagtgttcccctttaagtcagctgtcttcactgtggagaacggaagcaccatccggtttgaaggagagatgtttcaaagggccctccaatattcctcaagctatggaattccagaacttctgtcctggctaaaacagttgcaaataaaattgcataatcctccgactgtcaactactcacccaacgaaggacagatggacctctgcatcacatctggctgtcaagacggtctctgtaaggtgtttgaaatgctcatcaatcctggagacactgttctggtcaatgaaccactgtattcaggagccctttttgcaatgaaaccactgggctgcaattttattagtgtccccagtgatgactgtgggattattccagagggtctcaaaaaagtactttcccagtggaaaccagaagattccaaggatcccacaaaaaggactccaaaatttctgtatactattccgaatggcaacaaccctacaggcaactcgttgactggtgaccgcaagaaagaaatctatgagcttgcaagaaaatatgacttcctcataatagaagacgatccttactattttctccagttcaccaagccttgggaaccaacctttctctccatggatgttgatgggagagttatcagagctgactccctttcaaaagttatctcctcagggctgagagtggggtttataactggccccaagtccttgatacagaggattgttctccacacacaaatctcatcactgcatccctgtactttatcacagctcatgatatcggagcttctataccagtggggagaagagggtttcctggcccatgttgacagagctattgatttctacaagaaccagagggattttatattggcagctgcagacaagtggttacgtggtttggcagagtggcatgttcccaaagctggcatgtttctatggattaaagttaacggaatctctgatgcaaaaaaactaattgaagaaaaggctattgaaagagagatcttgttagttcctggaaatagtttcttcgtcgataattcagccccctcctccttcttcagagcatccttctctcaggttactccagcgcagatggacttagtcttccagagattggcccaactcataaaagacgtttcataaagaaatcaaactcagcattgaacttataattttaaaataaatttcctatactttgctgaagaaatggctgacaggatggatccagtttgtgaaatatctgtggcaatttcactgaacaactttgaagccccttaaaatccaccgcattgccaaaataactttctgatatacttttgccctttgattaattatgaactaacaaaacatcaaatttcattgttaaagacctctgtagctgcttaataatgtccaataaatttttttgagcctaacatagactaactaacatagtaaattgcaagggaattagttaaaatggcctataatatgcaggtttttttctactttaaggaaatttcatgagcatttactgcaaaaattgttgtaatttgacaattataaattactttgtaaccgaaaaaaaaaaaaaaaaaaaaa

SEQ ID NO: 117 - DNA, 2260 bp, Rattus norvegicus
gggcgactaggaccttgtgcacacagagcagcagcagaaaccggggcgatgctacgggtgcggtgtctgcgcggcggcagccgaggcgccgaggcggtgcactacatcggctctcggcttggaggatccttaacaggatgggtgcagcgaactttccagagcacccaggcagctacagcttcctcccaaaattcctgtgcagctgaagacaaggccacccaccccctgcccaaggactgccctgtctcctcttacaacgaatgggaccctttagaggaagtgatagtgggcagagctgaaaatgcctgtgtcccaccattcacagtggaggtgaaggccaatacatatgaaaagtactggccgttttaccagaaaaatggaggtctttattttcccaaagatcatctgaagaaggctgttgccgaggtcgaagagatgtgcaatattttatcaatggaaggcgtgaccgtgaagcggcctgaccccattgactggtcactgaagtataagactcctgattttgagtctacaggtttatacagcgcgatgcctcgagacatcctgatggttgtggggaatgagattatagaggctcccatggcatggcgctcacgcttctttgagtaccgcgcatacaggtcaattatcaaagactacttccaccgtggtgccaagtggacaacggcccccaagcccacaatggctgacgaactgtatgaccaggactatcccatccattctgtggaagacagacacaaattggccgctcaggggaagttcgtgacaaccgagttcgagccttgctttgatgctgctgacttcattcgagctggaagagatatttttgcgcagagaagccaggttacaaactacctgggcatcgagtggatgcgtaggcatcttgccccagactacagagtgcatatcatctcgtttaaagaccccaatccaatgcatattgatgccaccttcaacatcattggacctggtcttgtgctctccaaccctgaccgtccatgccatcagattgatcttttcaagaaagcaggatggaccatagttacccctccaacacctgtgatccccgatgatcatcccctctggatgtcatccaagtggctctccatgaacgtcttaatgctagatgagaagcgcgtgatggtagacgccaatgaggtcccaattcagaagatgtttgagaagctgggtatcagcaccattaaggttaacattcgaaatgccaattccctaggaggaggcttccactgctggacctgcgacgtccgccgccgaggcacccttcagtcctactttgactgagcggccgtggtgtggcttggggcatagcctcagatatacctaagaagcagcaaggcccttctctcgctttaataaatgcatgaactgtagtgctttgaacaatcacctccttaacagggttcccaaacctgggttactttttgttgacataaggaaggataacttttgataggtcttactttcttctcctaaagttatttacaatttggcttcaaatataaaagttgagtaaatgtataccagggcagaaattagtcatttgagtaacttggccgctaatatttaaccatctacctctgtttttaatcttctttcctaaaggcagcttgaaatgtcggtcctaaccttgtcttcttttcctctttggtggacttgtgaatgttcatattacttcaaagacttaggagaaaaacacagaccctaagtagaaccagatatttgtctatttttcaaaaataattggatgttttttaaaattttgtttttaaataacctagactatgcaaacactggaaaaaaaatgaagtaacttttccatgaatgcttttaacattcttgtgtcaccatttggtactaaactctagtcctgcctcttacctcatttcaagtgggttttcctcccttccttccttccttcctcccttccttctttccttcctttcttccaaaaacttagagaagtgcttggtttaatagagtgaaacttgtagatcctattcctaaaggttgatgatgttcagtatcaacaggtaaaatggcatctttgttaatctgtcttgtttacatatatgcaaattatttaaggcatagagttttaaagcattttttaaaaactaatgcaggtaaaagaaatacatgtgacatgaaataattttaatgttggatattgtatatgtatttttattctaataaagttttgtgttccagattggaaaaaaaa

SEQ ID NO: 118 - DNA, 1386 bp, Rattus norvegicus
ctgctgcccagtgctcttcagcatgtcctttattccggtggccgaggactccgactttcccatccaaaacctgccctatggcgttttctccactcaaagcaacccaaagccacggattggtgtggccatcggtgaccagatcttggacctgagtgtcattaaacacctctttaccggacctgtcctctccaaacatcagcatgtcttcgatgagacaactctcaatagctttatgggcctcggccaagcggcatggaaggaggcaagagcatctttacagaacttactgtctgccagccaagcccagctcagagatgacaaggagcttcggcagcgtgcattcacctcccaggcttctgccacgatgcaccttcctgctaccataggagactacacggacttctactcctctctgcagcatgccactaacgttggcattatgttcaggggcaaggagaatgcgctgttgcccaattggctccacttacctgtgggataccatggccgagcttcctccgttgtggtgtctggtaccccaattcgaagacccatgggacagatgagacctgataactcaaagcctcctgtgtacggtgccagcaaacgcttagacatggagttggaaatggctttctttgtaggccctgggaacagattcggcgagccaatccccatttccaaggcccaggagcacattttcgggatggtcctcatgaacgactggagtgctcgagacatccagcaatgggagtacgtcccccttgggccattcctggggaaaagttttggaaccaccatctccccatgggtggtgcccatggatgctctcatgccctttgtggtgccaaacccaaagcaggaccctaagcccctgccatatctctgccacagccagccctacacatttgatatcaacctgtccgttgctttgaaaggagaaggaatgagccaggcagctaccatctgcaggtccaactttaagcacatgtactggaccattctgcagcaactgacacaccactctgttaatggatgcaatctgagacctggggacctcttggcttctggaaccatcagtggatcagaccctgaaagctttggctccatgctggaactgtcctggaagggaacaaaggctatcgatgtggggcaggggcaaaccaggacctttcttctggacggagatgaagtcatcataacaggtcactgccagggggatggctaccgtgttggttttggccaatgtgctgggaaagtgctgcctgccctctcgccagcctgaagctccagaatccacagaacacagccttgccttgtgaggatcatactgcaactgcatgagtcaggaatgaataaagctattttgattggggaaaaaaaaaaaaa

SEQ ID NO: 119 - DNA, 1796 bp, Rattus norvegicus
gttcacagccactgcgccctcgctctcttcttgcagatcttgcagccgcagcaagccaggccacctcgtccttcgaagccatgtccaccaggtccgtgtcctcgtcctcctaccgcaggatgttcggtggctccggcacatcgagccggcccagctccaaccggagctatgtgaccacatccacccgcacctacagcctaggcagcgcgctgcgccccagcactagccgcagcctctattcctcgtccccgggtggcgcctatgtgacccggtcctccgccgtgcgcctgcggagcagcatgcccggcgtgcggctgctgcaggactccgtggacttctcgctggccgacgccatcaacaccgagttcaagaacacccgcaccaacgagaaggtggaattgcaggagctgaatgaccgcttcgccaactacatcgacaaggtgcgcttcctcgagcagcagaacaaaatcctgctggccgagctcgagcagcttaagggccagggcaagtcgcgcctgggcgacctctacgaggaggagatgagggagttgcgccggcaggtggatcagctcaccaatgacaaggcccgtgtcgaggtggagagggacaacctggccgaggacatcatgcggctgcgagaaaaattgcaggaggagatgctccagagggaggaagccgagagcaccctgcagtcattcagacaggatgttgacaatgcttctctggcacgtcttgaccttgaacgtaaagtggaatccttgcaggaagaaattgcctttttgaagaagctgcacgatgaagagatccaggagctgcaggcccagattcaggaacagcatgtccagatcgatgtggacgtttccaagcctgacctcaccgctgccctgcgtgatgtccgccagcagtatgaaagtgtggctgccaagaacctccaggaggccgaggaatggtacaagtccaagtttgctgacctctctgaggctgccaaccggaacaacgatgccctgcgccaggcaaagcaggagtcaaacgaataccggagacaggtgcagtcactcacctgcgaagtggatgcccttaaaggcactaatgagtccctggagcgccagatgcgtgaaatggaagagaattttgcccttgaagctgctaactaccaggacactattggccgcctgcaggatgagatccagaacatgaaggaagagatggctcgccaccttcgtgaataccaggacctgctcaatgtaaagatggctcttgacattgagatcgccacctacaggaagctgctggaaggggaggagagcaggatttctctgcctcttccaaacttttcttccctgaacctgagagaaactaacctggagtcacttcctctggttgacacccactccaaaagaacactcctgattaagacggttgaaaccagagacggacaggtgatcaatgagacttctcagcaccacgatgaccttgaataaaaactgcacaggctcagtgcaacggcgcagtaccagcaagaaggaaaaaaaaatcgtatcttagaaaaaagagctttcaagtgcctttactgcagttttcaggagcgcaagatagatctgggatagaaacgagctcagcacataacaactgacacccccaaaaggcgtagaaaaggtttacaaaataatctagttttacgaagaaatcttgtgctagaatactttttaaagtatttttgaataccattaaaactgctttctttttccagaaaatatctgaccaacttgttactgcttcaataaaacttcagaaat

SEQ ID NO: 120 - DNA, 499 bp, Rattus rattus
cccacttaaaacggaaacacctttattgacagtataggacagttaaaacgcacgcaaggacaaagatgagaccacagaggtgtaaagttgcagcacaggagttaatattcttcaccctcatcgtctccttcagcactatctgccccaacctcctcataatccttctctagggcagccatatcctcacgggcctcagagaactccccctcctccatgccctcacccacataccagtgcacaaaggcacgcttggcatacatcagatcaaacttgtgatccaggcgagcccaggcctcagcaatggctgtggtgttgctcagcatacacacagctctctgcaccctggccaggtcgccaccaggtaccacagtgggaggctggtaattaatgccaaccttgaagccagtggggcaccagtccacaaactggatggtacgcttggtcttgatggtggcaatggcagcattgacatccttggggaccacatcaccacggtaca

SEQ ID NO: 121 - DNA, 2870 bp, Rattus norvegicus
gaattccggcgtttgcagccgtcgtttgattagtcgcctctcgcggattaggagctagcgtctcccgcccgcctgccgccccggtgccgctgggaggaagcgagagggaggctgcctgtgggtttgtcactgctgttgctcctccacctgagtgagtcaagcccgggcctagtcggtcgcctaccattctcgtagccgttaccctcaggccgccacagccgccgaccgggagaggcgcgcgccatggcctctggagccgattcaaaaggtgatgatttatcaacagccattctcaaacagaagaaccgtcccaatcggttaattgttgatgaagccatcaatgaagataacagtgtggtgtccttgtcccagcccaagatggatgaactacagttgttcagaggtgacacggtgttgctaaaaggaaagaagagaagggaagctgtatgcattgttctttctgatgacacgtgttctgatgagaagattcgaatgaatagagttgttcggaataacctccgagttcgcctaggagatgtcatcagcatccagccatgccctgatgtaaagtatggcaaacgtatccatgtgctacccattgatgacacagtggaaggcatcactggcaatctttttgaggtataccttaagccgtacttcctggaagcatatcggcccatccgtaaaggagatattttccttgtccggggtgggatgcgtgctgtggagttcaaagtagtagagacagatcccagcccttactgtattgttgctccagacacagtgatccactgtgagggggagccaatcaagcgagaggatgaggaggagtccttgaatgaagtaggctatgatgacatcggtggttgcaggaagcagctagctcagataaaggagatggtggagctgccactgagacatcctgcactctttaaggcaattggtgtgaagcctcctcggggaatcttgctatatggacctcctgggacagggaaaaccttgattgcccgagctgtggcaaatgaaactggagccttcttctttctgatcaatggtcctgaaatcatgagcaaattggctggtgagtctgagagcaaccttcgtaaagcctttgaggaagctgaaaagaatgctcctgccatcatcttcatcgacgagcttgatgccattgcacccaaaagagagaaaactcacggggaagtggagcgtcgcatcgtgtctcagttgttgacccttatggatggcctaaagcagagagcacatgtgatagttatggcagcaaccaatagacccaacagcattgacccagccctacggcgatttggtcgctttgacagagaggtagatattggaatccctgatgctacaggacgtttggaaattcttcagatccataccaagaacatgaaactggcagatgatgtggacttggaacaggtagccaatgagactcatggtcatgtgggtgctgacttggcagccctgtgttcagaggctgctctacaggccatccggaaaaaaatggacctcattgacctagaagatgagaccattgacgctgaggtcatgaattccctggcagttactatggatgacttccggtgggccttaagtcaaagcaacccatcagcacttcgggaaactgtggtagaagtgccacaagtaacctgggaagacattggaggcctggaggatgtcaaacgggagcttcaggagttggttcagtatcctgtggagcatccagacaaattcctcaaatttggcatgactccttccaaaggtgttcttttctatggaccgcctggctgtgggaaaaccttactggccaaagccattgctaatgaatgccaggctaacttcatctccatcaagggtcctgagctgcttaccatgtggtttggggaatctgaggccaatgtcagggaaatatttgacaaggcacgacaagctgccccctgtgtactcttctttgatgagttagattcaattgccaaggctcgtggtggtaatattggagatggtggtggagctgcagaccgagtcatcaatcagatcctgacagaaatggatggcatgtccacaaaaaagaatgtgtttatcattggagctaccaaccggcctgacatcattgatcctgctatcctaagacctggccgtcttgatcagctcatttatatcccacttcctgatgagaagtcccgtgttgccatcctaaaagccaatctgcgaaaatccccagttgccaaggatgtggatttggagttcttggctaagatgactaatggcttttctggagctgacctgacagaaatttgccaacgtgcttgtaaactagccattcgtgaatctatcgagagtgagattaggcgagaacgagagaggcagacaaatccatcagctatggaagtagaagaggatgatccagtgcctgagatccgcagagatcactttgaggaagccatgcgttttgcccgacgttctgtcagtgataatgacattcggaagtatgaaatgtttgcccagacactgcagcaaagtcgaggttttggcagcttcagattcccttcagggaaccagggtggagctggcccaagtcagggcagtggaggtggcacaggtggcaatgtgtacacagaagacaatgacgatgacctctatggctaagtgatgtgccagcatgcagcgagctggcctggctggaccttgttccctgggggtgggggcgctcgcccaatgggaaccaggggtgtgcccatggcctgttccattcctcagtccgaacagttcagccccagtcagactctggacgggggttttctgttgcaaaaaaattacaaaagcgataaaataaaagtgattttcatttggga

SEQ ID NO: 122 - DNA, 2925 bp, Rattus norvegicus
atggcggcagaagcagctggtgggaaatacaggagcacagtcagcaaaagcaaagacccctcggggctgctcatctcggtgatcaggactctgtctaccagtgatgatgttgaagaccgagaaaatgagaaaggtcgccttgaagaagcctatgagaagtgtgaccgtgacctggatgaattgatcgttcagcactacacagaattgacaacagccattcgcacataccagagcatcacagaacgcatcactaactccaggaataaaatcaagcaggtaaaagagaacctgctttcctgcaagatgctgttgcattgcaaacgggatgagcttcgtaaactatggattgaaggaattgagcataagcatgtcctgaaccttctggatgagattgaaaacatcaagcaagtgcctcaaaagctggaacagtgcatggccagcaagcactacctcagcgccacggacatgctggtgtcagcagtggagtctctggagggtccgctgctccaggtggaaggactcagtgacctcaggctggaacttcacagcaagaagatgaacctgcacttggttctcatagaggaactgcaccgacatctgtacatcaaatccactagccgggttgtacagcgtaacaaggaaaaagggaagatgagttctcatggcaaagatgcttctcctggtcctctgattgatgtttcaaacatctctactccacgcaaattccttgatgccactcaatattctgctgctggaagctcaagtgtgagggagatgaacctgcaggacatcaaagaggacttggactgtgatcctgaggagaacagcactcttttcatgggaattcttattcaggggctggccagactgaagaagatccctgagaccgttaaagccattaaagagcgtttggagcaggagctaaagcagattgtgaagaggtcaaccacccaggtggcagacagtgcctatcagaggggagagagcctcactgtggacaaccagccaaggttacttctagaactgctggaactgttgtttgataagtttaatgctgtagccagtgcacattctatagtcctggggtaccttcaggactctgtggggacccagccaacacagcaggaagagatcaaattatacgatatggcagatgtgtgggtgaagatccaggatgtgctgcagatgctgttgactgaatacttggatatgaagaacacacgtactgcgtcagagccgtcagctcaactaagctatgccagtactggacgagagttcgcagccttttttgccaagaagaaaccacaaaggccaaagaattctcttttcaagtttgaatcatcctcccatgctatcagtatgagcgcctatctccgagaacagagaagggagctgtacagtcggagtggagaacttcaaggaggtcctgatgacaacttaattgaaggtggaggaacaaaatttgtctgcaaacctggagccagaaatattaccgtcatattccatccactgctgagatttattcaggagattgagcatgccctgggacttggccctgccaaacagtgtctccttcgagagtttctcactatatatatcaagaacatcttccttaatcaggtcttgactgagatcaacaaggagatcgaaggtgtcaccaaaacctcagaccccttgaagatcctagctaatgcagacaccatgaaggttctgggcgtgcagaggcctcttctacagagcaccatcatcgtggagaagacagtacaagacctcatgaacctgatgcatgacttgagtgcatattcagatcagttcctcaacatggtgtgtgtgaagctacaggaatacaaggacacatgctccacagcctacagaggcattgtccaatcagaagagaaacttgtcatcagtgcatcttgggcaaaagatgatgatatcagcagactcttgaaatcactgccgaactggactaacatggctcagcccaaacagctaaggcctaagagagaggaggaggaagacttcataagggcagcctttggcaaggagtctgaggttctgattggaaaccttggtgacaaactcattcctccacaagatattctccgtgacgtcagtgacctcaaagccttggccaacatgcatgaaagcctggaatggctggcaggccgaacaaagtcagctttctccagcctttctgcatcccagatgctttcccctgctcaagagagccacgtaaacatggaccttcctccagtgtctgaacagatcatgcagacgctgagtgaacttgccaagtccttccaggacatggctgaccgctgcttgctcgtcttgcatctggaagtgagagttcattgtttccactatctcatccctctggcaaaggaggggaactatgccattgtggccaatgtggaaagcatggattatgaccctttagtggtcaagctcaacaaagacatcagtgccatggaagaggccatgagcgccagcctccagcaacacaagttccagtacatcttcgaaggtctgggacacctcatctcctgtatcctcattaatggggctcagtacttccggcgcatcagtgagtctggcatcaagaaaatgtgtagaaacatttttgttcttcagcagaatttgaccaacatcaccatgtcacgggaggcagacttggactttgcaagacagtactacgagatgctgtacaacactgctgatgagctcctgaacctggtggtggaccagggtgtgaaatacacagagctagagtacatccatgccctgaccctgctgcaccgaagccagactggcgtgggggaccagaccacccagaacaccaggctgcagagactcaaggagatcatctgtgagcaggctgccatcaagcaagccaccaaggacaagaaaataaccactgtg

SEQ ID NO: 123 - DNA, 1430 bp, Rattus norvegicus
atggcttaccacagcttcctggtggaacccatcagctgccatgcctggaacaaggaccgtactcagatcgccatctgccccaacaaccacgaggtgcacatctacgagaagagcggtgccaagtggaacaaggtgcacgagctcaaggagcacaacgggcaggtgacaggcatcgactgggcccccgagagtaaccgcattgtgacctgcggcacagaccgcaatgcctatgtgtggacgctgaagggccgcacgtggaagcccacgctggtcatccttcggattaatcgagctgcccgctgcgtgcgctgggcccccaatgagaacaagttcgccgtgggcagtggctcccgtgtcatttccatctgttattttgagcaggagaatgactggtgggtgtgcaaacacatcaaaaagcccatccgctccactgtccttagcctggactggcaccccaacaacgtgctcctggctgcaggctcctgtgacttcaagtgcaggatcttctctgcctatatcaaggaggtggaggaacggccagcccctacaccgtggggctccaagatgccctttggggagctgatgtttgaatcgagcagcagctgtggctgggtgcatggtgtctgcttctcggccggtgggagccgagttgcttgggtcagccatgacagcactgtgtgcctggtagatgctgagaagaagatggccgtggcaaccctggcctctgagacattaccgctcctggccatcaccttcatcacagaaaatagtctcgtggcagcgggccacgactgcttcccggtgctgtttacctatgacaacgctgcggggacattgagctttggtggccggctggatgtgcccaagcagaactcccagcgtggcctgacagcccgagagcgcttccagaacctcgacaagaaggccagctctgaagggggtgcagccacaggggctggcctggattcactgcacaagaacagcgtcagtcaaatctcggtgctcagcgggggcaaggccaagtgctcgcagttctgcaccacaggcatggacggtggcatgagcatctgggatgtgaagagcttggagtcagccttgaaggacctgaagatcagatgagctgtgaggagtgctgtcctcatcccacatgctggggaggagggaaaggggttggggaggctaagggctgctttgctgaatgcttctagggtgtagtacaggtctgcaaaggggatgctctctctccaaagaggggaagaggaaggtggggaactttcctgcctatttaatgaaaatgtgccttttaaagagatgctttcattcattgcaaaccaaaaacaagacaaaaaacccaaagcacaatgctggtcataaactgcttcaaaatgtgggctaataaacataccaaatgtgaaaaaaaaaaaaaaaaa

SEQ ID NO: 124 - DNA, 8797 bp, Rattus norvegicus
  misc_feature (1709)..(1709): n is a, c, g, or t
  misc_feature (1714)..(1714): n is a, c, g, or t
  misc_feature (1759)..(1759): n is a, c, g, or t
  misc_feature (1804)..(1804): n is a, c, g, or t
  misc_feature (2050)..(2050): n is a, c, g, or t
  misc_feature (2054)..(2055): n is a, c, g, or t
  misc_feature (2078)..(2078): n is a, c, g, or t
  misc_feature (2083)..(2083): n is a, c, g, or t
  misc_feature (2115)..(2115): n is a, c, g, or t
agaagcagggcaagatggagcggagacgtatcacctctgcacgccgctcctatgcctcctccgagacgatggtcaggggccatggtcctaccagacacctgggtaccattccgcgcctctccctgtctcgaatgacgcctccactccctgccagggtagacttctccctggccggggcgctcaatgccggcttcaaagagactcgggccagcgagcgcgcggagatgatggagctcaatgaccgctttgctagctacatcgagaaggtccgcttcctggaacagcaaaacaaggcgctggcagctgagctgaaccagcttcgagccaaggagcccaccaaactggctgacgtttaccaggcagaacttcgggagctgcggctgcgtctggaccagcttactaccaacagtgcccggctggaggtggagagggacaatctcacacaggacctcggcaccctgaggcagaagtgagaaggggaataggaaaatggctagtgagcagagagactgaattgagagaggagcctggaagaagggtactgcctccccctaaggagagcctcttagctgctgtgtttcaaaagggagagctgtctttgttccctaatatgatgcagaatagccaggaagagactgaaaacttcagggatcagattcccagagagagctgagcattctgggtacttaccaccaagctgagggaggactgtgtgtgggtagccagggtacaagcaggcaggtgcttcagtcactgggcactatgaatggccagagaggtttgcgtccacaaggagggctcttggtctctgaaatataagaaatgcaagaaagagcaggcaggcctggatgccgggcccagatggctgtctacgacctgcttttgaccctgctcaagtcattttgattggttgtagctgtaaaggagaggtcatgatacaatctgtcctaaaagatggtaaccgaggtcaaactctggggcgtggtgctttgctgggtggtggatattcacgtgtccctctggtgcaggaggggcactggtgtcagtgacagtgggcgcacggtggtggatgcgcctctgggaacaagagcaggtggcaccaaccccgataaggcacctcagtaatgagttaaggaggaaggctcttatctgttcacgcgtcaccaggcctctgtgtaggaacctgccattgcttactcttcctgccactctaccgatcctgtgggatccgtttgtaacartcccctccctctggaggttcggatagggacccaagagtcctcaggaaaacctaaagcctgtactgtgttccctgtcccaggctccaagatgaaaccaacctgaggctggaggcggagaacaacctggctgtgtacagacaggtcagagagatgagaggaagggtggggagggaaggcggaggcccgccaccaaacaccgcagttgtctgcttccaagatccccacaaggagggggaagacaaagttggaaattttagtagctaggaccctggggtcaaagagattctctccctgctccaggaggcggatgaagccaccttggctcgtgtggatctggagaggaaggttgagtcgctggaggaggagatccagttcttgaggaagatccatgaggaggtgaggccagggagggggagggaggggccttacgagaaactgcaggtaatagacagagacgctcacagaggnaaacngagaaaccaaatttcaggaagaaaacaaaaacaagagaaagagtnaagacagagacttagggagatgtgtccagtatttactacccgtgnaaacacacgcaggccttccgccgccatgttctaagaagcacagaaccgagtctgagtttctccttcacatcagctctcagccttatcactacctcttccacaactgtagggaccttgaggcctagagagtgaaacacacccaaagtcacacagctagaacccctctagacctgtcacagtggtatgcatctcagcctgtgagtggtagacgcggaacgtttgaactgttcaaggccaatttcwgcnacannaghaaactgaaaccagccacgcnccgcncgcgcacatctattctcttacctcagaacctngctgcaagacatattyattcatgcctggttcctgactatgcagtcctgagaggaaggcacctcaaattctacttccatgcccattagacgctttacttttactttttgacaggatatcactgtgtagctggcctggaacatgcacttcctccagtaacatctgcctcatttccgtgagccattgctataaatggcagacagaggcgtgagtctgggagagtgcagcctaggccgtagcttgagccttaataccccttcttttaccttattaggaagttcgagaactccaggagcagctggcccagcagcaggtccacgtggagatggatgtggccaagccagacctcacagcggctctgagagagattcgcactcagtacgaggcagtggccaccagtaacatgcaagaaacagaagagtggtatcggtccaaggtacctgtggggcagcttgcctcttccaggaagtcttcctgctccctcctgaagaataaaggaaggaaggaagctagggaagggtaacctatctaggtgtccagtcttgcccagagagaggagacttgcccagaaccacgcaagcattattaacttcccaaactactcttggttactgctattataagtaatatcagtaatagttaataatagctaaaggctcaccagtttgctcagtgtcacacagctcctaagtgacaaagggatagcgtttcctatcctaacccatatcatcagagagcctgctttttgatgcctctgccagcctatgccctgcattaccgaacatctactgtgtgtcacgttctttttttctttttttggagctggggaccgaacccagggccttgcacttgctaagcaagcgctctaccactgagctaagtcccaaccccgtgtgccacgttctttagtccagatgaggccagcgtttatacagactgtaggaggcagggacgatgggggatggactaggggtgggacttgtgctagacaggcagcctagagactcaggagaagagggaagggcatctcaggtggagaacaggggctgtgaggaggcctgagacagaaaagcacagagaccagaaatgtcgctgcccagggcgccaagcccagtgtgagttaatgagcctcacatgcagggacagtctgggaggatgaaggcctaagaagttcttgggctacagttgttcctcctaagggagccctgaggttcctggtttttcagtgatcatgtatatctcccagctcaggcagctctctgggctgtgccttgcgcactttccctcaatttttggtcctctctgggtttagtttgcagacctcacagacgttgcttcccgcaacgcagagctgctccgccaggccaagcacgaggctaatgactatcgccgccaactgcaggccttgacctgcgaccttgagtccttgcgcggcacggtgagcacggatcactggttggatggggcagcaagaggttgctggagggggacagggatggagggaccggggtggcataggcgaacacggaagagatcaggggttgcagcctcgaagtttctcaaaatctcccggccaagcgatcagttccatcccgcagaacgagtccttggagaggcaaatgcgcgaacaggaggagcgccacgcgcgggagtcggcgagttaccaggaggcactcgctcggctggaggaggagggccaaagcctcaaggaggagatggcccgccacctgcaggagtaccaggatctactcaacgttaagctagccctggacatcgagatcgccacctacaggaaattgctggagggcgaagaaaaccggtgagctctacctcagcccgagaattcctcttgttcctttacagtactccggagttagccttgtatccttcccacccagagtgttcagcctacgaacaatagatattcaagaaatgtctgaagaatagatgggtccaactactggtaattctcgggactgaggacttgagttattccccagattaagtggcttaccacaagcatggccaacaaaaatggaatttcccatggtctgaagggcttgttctgcctctatgaagttattgtgacttaaaaaaaaaattccatctccaaagcctccttcctggaagtattctgtgggggcagataacacagtcctgcagacacttccggctcctggagagtgttggctgctgggttgaaagttggtggtggaggctggagagatagttagggctttgggttccaacatccatcttatggcttgcaatggcttgtagtaacactccagttccaggggaacccacatctgccattgtatgtgtgtgtgtgtgtgtgtgtgtgtgtgtgtgtgtgtgtgtgtgtgtatgtatgcatgcatgtatgtatgtatgtatgtatgtatgtatcagtcattatgttgctgctttagtcccagcacttgagaggaagaggccagcagatctctgtgagtttgaggctaacctggtatatatattgaatcagcgccatatagagaggctttgtaagaaaaagttggcgaagagaaagagaggagaggagacagagaggagcagaaaggagagagagcaggagagagacagacagacagacagacacacacacgcatgcacacaggacagagagaaaatgtgtgtgtgtgtgtgaaagagagagagagtgtgtgtgtgtgtgtgtatgtgagtgtgtgtgtgtatgtgtgtgtgtgtgtgtgtgtgtgtgtgtgtgtgtgtgtgtcctggtaaagggctttgagattttcatgctggccctggaccagccctggcctggggatgtcctagggcagcctcctcatccctatccctccttttccagcatcaccattcctgtacagactttctccaacctccagatccgaggtcagtatagtggggccttgtgggaaagggtaatgaatcccctccctcctcccccaggcctgtgaactgctctcatggactgggaggcaaagagacccacgctctccttgagagcttcgtgaccctccacggagaccctagatggagtgcagaatcttagggcttatagctggtccctgcctccctctgccctgtgtccccatcccctggaaaacccaacaggtctcaactgatgccaggtctgcaagccatgaacaagctccgccttctaagtgttttgtgttcttgttttttttttttttttttctcctctctctcttaactgcttgtcactacagggggcaaaagcaccaaagaaggggaaggccacaaagtcacaagacatctcaaaaggctcacaatacaagttataccaatacaggctctcgccagattgtaaacggagtcctgccagcactccgttagacacgtgcacttcagttgtgtacttttcccggcttgccttcttcctcccaggcctcttctaagggactgtaccgtgtcctttgtccagaaccttcagtacccacgctaggtcctggctctgtgtaattaggttatactgatagagctagcctacgttaaaggttaggtcatgctaacagagctagcctatgctaacagagctagcctatgctcaaggtgaggtcatgctaacagagctagcctgtgttaaaggcagcatgtctctgggagctcaaaggagatgctctgacccctctgagcaaatgcctctgcctcaccacttttgtgtcgctaggtggtccccttggattgcagtgcctgtgggcaggctctgtgtttgattcatgtgtccccagagttctattgcttcattcagtgctgactcagcccagaggttccccctggatggctgctcttgtagtgaataaactctaggttccctgctcttcgttttacatattagtgagtggcgacacgtatattttcctctctaagggggttggatcaaattacgttttactggtatgtggcccttaaatgattcttagatatgggggaagattccatttaggaacattggccgtgcatattgcagggtgtaattgagctttagaaagttaaccatgctggccaggcaaaggtgccaaataccaggcagtcaaaggtcactagagccagataagtgacagggaaataagaatggggaaaggtccgtgcgtattaaccactaatctgcaccacgtggtatacgtcagtgagttgacactcgcatgtccaggagtagtcactatgagcccattttgtaagagaggaaactgaggctccttccttggtgcagcccttggctgtctctcagccaggtgccagaacagaaggcagagcgggctacaggacagcagcagggtgtgcccagcgctgggggacagatgggagtctccagtcacttcggaaaagtcatgcttttcgctgcctagctagttagccccgtccgtattcacgatcctgggtgcatgatggggaacttgggtgcagggcaggatgtctagtgtcccaagagcccacggagacctcctctcctcgtacctgcagaaaccagcctggacaccaaatctgtgtcagaaggccacctcaagaggaacatcgtggtaaagacggtggagatgcgggatggcgaggtgaggaaacgttccagtggccccggggagttcttgaggctgtactggagaaagcctggtactagctcactgaaggtccttattaactaccaggagagctctggtagaagggatgggccttgaatgtaattctccttttccagctctttcatgggtggcgtgctaagggcaacctgtatatggaggccaccatctttctggaacacttggtggagggaggctttcaaattttactcagaagaactttccataggggaattggaagaggggctagacatagaatggccgtcttcatttgttgggatgttagcagcaatggttgcccttacgtcatagtcctctacaagtggcatttcatatctcaatgtgtgatgcaatcaagccgatagtcctggaagacacatccagggcagtcaggggctcgcctcggggatgctcagcctagcaaactggatctgggattctggagcccctaactctgtgctgtgactcttccctctgcctgcaggtcattaaggagtcgaagcaggagcacaaggatgtgatgtgaggtgtgcccagctggcggcccttgccatacagtgtgagggcctaaagctccctcctcagatagtcttgtttgctaggcccaattcccatccacaccagtgctccccttccttctgtttttatgcccacggctcggtcagtgcggagtctcatggacggcacagaccaccctgcatctccaactaacaggatactcaccccaaaggggcaatcaggaggggaggacccccctccccccagctgggttagaactggaagaaagaggaaagacaggggcagggagacttaacaaatcccttccttcatccttgttgttatggaaaccgttgccagagctggaggtctctgggaactggactttgagttttcataggctgctggagcaagacaaacattcagacagaaaggaaaagttcccgaggcaaagaatctctagccagaggcctaggcatctggaagaaccctgacgatgtaggagtgggtagggcagacttgctacctggaatggccactaaggcagtcctgaagggcccccctccggagggatgaccctcgtgtatcggccccactgagcagccctgcaggttgatgccccacgagcctgtgaaaacttggttcttggcatgtggcaggctctatagcataagtggagagggaaggtgtactggagggtatagaggagggctctctggcccctaagtatggatgcggagaggggggagcccaggaaggctaccccgctcaggctgcaggggtgccatggcggaggaaccggtggagataacttggacaatggagttggaagttgtaggcaactagttacacttggctctgaatccttggaatcaaggaaatgacctgttctctcaaagacactgaaacaggagagagggacttccatccactgggcagggtacaggcgcgtctcagttgtgaaggtctattcctggttgctcagtccccaactgcgcatcaccctgggcttctcaacctggaagagtccacaaccatccttctgaggccctccatccccacaaccactagctgttgttctccaagccaagggccccattccctttcttatgcatgtacggagtatcgcctagactttaagcgtccatcctgtttgaaagtttgggaaactgacacacgttgtgttcaagcagcctggtgtggagtgccttcgtattagtgtaccctctcggaagctggttggtgggcaggtgaggaagaaatggagctgaaagtgtcccctcagttgtcctttcctccccctctaaggtccctcacttttcccaggacatcgtacactcccccccttgtcacctctgctaaccttcagagcagtactgtcacctttactcactgggcagaaataaagacagtgtcagaggcttccacagagkatctgatttgttcagaaggtggggtgaggacagacaagacccaaccttgctcgttatcaccaccgaatgtctagcgagcctaaacttccacaacaaaccctccacagcagcagctggcgttaaatccgcctccaacgacgaggtgccct

SEQ ID NO: 125 - DNA, 1867 bp, Rattus norvegicus
agctttgcttctcagtggaaaagtaattttaacaagcaatttagtagttgattgagcaaatgcattgcaaaaaagaatgcttttgggacagcgttttcttcagagggagtacccagagctggcactcctgagccagtggcccagcatccagggagagatatgcttgtcatcaccgaagcctgatgctgtagagccacaccctggtattggccaatctgctcacacaggacagcgagagcaggagccaggcagagcataaaaggtggggcgggatcagtcgctcctcacatttgcttctgacatagttgtgttgactcacaaactcagaaacagacaccatggtgcacctgactgatgctgagaaggctgctgttaatggcctgtggggaaaggtgaaccctgatgatgttggtggcgaggccctgggcaggttggtatccaggttacaaggcaagtagaagtttggtgcttggagacagaggtctgctttccagcaggcactaacttttattgtatcctggctatgtttccctttgtaggctgctggttgtctacccttggacccagaggtactttgatagctttggggacctgtcctctgcctctgctatcatgggtaaccctaaggtgaaggcccatggcaagaaggtgataaacgccttcaatgatggcctgaaacacttggacaacctcaagggcacctttgctcatctgagtgaactccactgtgacaagctgcatgtggatcctgagaacttcagggtgagtctgatgggctcctcgctgggtgtccttcctgtggctttcctgctcaaattcctatcagaaggaaagaggaagccactctagggagcagttttgatgatgatgtgtggatgtgccctgtggagtgttgacaggagtccagttattttatcctctattcacaatcacttctccctctcactctattattctatgttgtcatttcctctttctttggtaaacttttaattttcagttgcagttttttctttttaaaaaaattaattaactgacttatttactttccatcccgatctcagcttcccctcctcctctcttcccagtccttctctctgctttctattaccctacctctttcttttctcctcagtccattttctcttttttcaatcaactttttgttttcttttaaatatttcttagtaactttctctgaggacaaggaagatatgtgagtccctgtttcttcccacagctctaaagagtagtagcagtaattggctttcatgccagagtggaagagaagaatatattttacaataaattctgtctgacatagaagaattctcattataatttttcagtactttaagttggaaacgaaaacaccatttgaaatgagcctgaagtgtctggtatttttgctctgcaattatgttgatggttcttccctcttcccacagctcctgggcaatatgattgtgattgtgttgggccaccacctgggcaaggaattcaccccctgtgcacaggctgccttccagaaggtggtggctggagtggccagtgccctggctcacaagtaccactaaacctcttttcctgctcttgtctttgtgcaatggtcaattgttcccaagagagcatctgtcagttgttgtcaaaatgacaaagacctttgaaaatctgtcctactaataaaaggcatttactttcactgcaatggtgtgttaaattaattgtatctcatagaagggttcatgcttaggtttcaaggtacaaagcagtgagggttcagttctgaccttggggaaataaatgatttgtgcttcatgatatatgctgggacagtaagctataaggcacagctcctaatgctccc

SEQ ID NO: 126 - DNA, 2657 bp, Rattus norvegicus
gttttttttttttttttttttttttttttttttttttatgaagaataagcgatccgtttgggatttattgcatttaaagacggcagattattaaaacagtaggtatgataaatacagtaagaaaataactttaaatctcaaacaaaacagtgaacagaattcaagactaagcaatgtaaaggcaataaggtaacaaaattagtgctttactgggtacagggaaagtaactgaagtctatctcaaactcttcccggctacatttgagggcttaagttactttagcaagtatgtctttataacaattagaaatataactaaggatataaacccagtttatttaaaaattaaagttatttgcttagtggtacataaaaggcttcagaaaattcaagtttaacaaaaaaaaaaaaaaaaggaagtgtaatcaaagaaagtgcacttaaagccgtttgccagcaattaaagggctcttccaggctggaggtgtggctcagccctaaagcgcttgcccagcatgtgcaaggccctgggttcagttcccagcaccgcaaaagaaagaacaagtggcaattactccttctagtataggatgatctctcagtcacaaaagaacatagtaataaaatcagtcttcctgtaggcactgtgaacctttaattaaaaaaaaataacctaaaccagacccagccctctgaattttcatctacttcttccttttagtggcttttgtaaacttcgtaactaggagtgaatgctcttaagagaaacgattgcctttttaaattcacattaattccgtagtggagagcctcgatgtgcctgtgtctttttatcttagtagagaacaccaccgagtgtaaatttttccaacagtcatctgttgttctctcagtagactcagtagactgtcaactcagtaactgaatgtaaattgatgactagttttgcttagaaataaaagaaaaagaatgacagagttcactgcgcattctacatgtattaaacagataatacctaactccccacaggtagtgacattaatacatgtgcgccttctgacagtgctttagtgaagtgcccaaatctggataacccaagggaggcacacccaagactggctccaccttcgtattttccgtcagaagaggagagtagtcagtccctgttaaacagggtaggactgatcgcaaggtgcgcagatccgagagccacgtgacttcataaatgcccagggtacacagctcaggggaggggcactcagtttaaatctggtcggttccattctcacccaacttggagtagtcctttctccaactacataccgagaacgtctgtgccttagtagataactttcttaagtgccctgaaagatcctctggtaatactagcgttttgctgacgtgatcaaagtaaagcaagtagtccactttttaagaaaagattccaagttaatgagcacagttaaagcttctaggtgacacctttggcctcagactttcgagctgggttcctaacgtgacttcccttcgatgttcaagtctaacaggtttagttagaactgctttgcacactgggaagcacaaggcacacccaaatgacattctttaaaccagaactgggccgtcccataacagagccagcctttcagtgagtgctgggtgctgggtgctgggtgctgggtgctaagtgctctcttgagcaagagaaatgtaacgcaaaggagccgccccttggacctccagtgaaacagtctgtccaatgagatgatctcgagaggcgcgtcaccgctgggctgttggaggcaatgtaaacattttaggctgtggcacagctgtttcctaaggatttgtccagcattagccggaggggctgcgagtgatcacttctaagtattcagtgcagtgaaaggcgagtggaactctgacttcatagtcacaactcattactttaggaggaaagcatttctgttcggtagcgtagagggcctactgccatttgcattagtgagaataatcaacctgagaaccagacagaaaggtgcaaacacagctctcctttggcacaaggacattaagtggtgaaggcatcagactccagcatcaactggaacaacctgaaaggcaagaagtcctgccatactggagtagacagaaccgccggctggaacatccctatgggcctgctgttcagcaggatcaaccactgcaagttcggtgagcagagccgggaagggagattgggaggggccatgcagaaaaaaaggggccctaagaagggccataggtttggggtccataaaagtgaagcccctcaaaaatgaacctcaaggaaatagggaagaggactaggaggaaccaggggctaaggaatggagtcaggacggttgtctttattgcaaataatggcattagtggctatacattcgcttgtctctctcatgatggagatcagaggtgagcattctgtggctgataaggtcttgagggctccttccttctttctggaccatcatttccatcatagtacttccacattcaaaaagcaaccttgctgaggcagtcacaattcaggcaagaacgagagcaagtggaaatgtacaccaaccgtggtcagtgtttgaaaagagccttctgctgggttcggtccccagctctga

SEQ ID NO: 127 - DNA, 2293 bp, Rattus norvegicus
cgtccgctcctcgccacacacaccgagaggatgaggttcgctgtgggtgccctgctggcttgtgccgccctgggactgtgtctggctgtccctgacaaaacggtcaaatggtgcgcagtgtctgagcatgagaacaccaagtgtatcagtttccgtgaccacatgaaaaccgtccttccagctgatggcccccggcttgcctgtgtgaagaaaacctcctatcaagattgcatcaaggccatttctggaggtgaagctgatgccattaccttggatgggggttgggtgtacgatgcaggcctgactcccaacaacctgaagcctgtggcagcagagttttatggatcacttgaacatccacagacccactacttggctgtggccgtggtgaagaagggaacagacttccagctgaaccagctccagggcaagaagtcctgccacactggcctgggcaggtctgcaggctggattatccccattggcttacttttctgtaacttgccagagccccgcaagcctcttgagaaagctgtggccagtttcttctcgggcagttgtgtcccctgtgcagatccagtggccttcccccagctgtgtcaactgtgtccaggctgtggctgctccccgactcaaccgttctttggctacgtaggcgccttcaagtgtctgagagatggaggtggagatgtggcctttgtcaagcatacaaccatatttgaggtcttgccacagaaggctgacagggatcaatatgagctgctctgccttgacaatacccgcaagccagtggatcagtatgaggactgctacctagcccggatcccttctcatgctgttgtggctcgaaatggagatggcaaagaggacttgatctgggagatcctcaaagtggctcaggaacactttggcaaaggcaaatcaaaagacttccaactgttcggctctcctcttgggaaagacctgctgtttaaggattctgcctttggctgttacggggtgcccccaaggatggactacaggctgtacctcggccacagctatgtcactgccattcgaaatcagcgggaaggcgtgtgcccggaggcctccatcgacagcgcgccagtgaaatggtgtgcactgagtcaccaagagagagccaagtgtgatgagtggagcgtcacgagcaatgggcagatagagtgtgagtcagcagagagcactgaggactgcattgacaagattgtgaatggagaagcagatgccatgagcttggatggaggtcatgcctacatagcaggccagtgtggactagtgcccgtcatggcagagaactatgatatctcttcgtgtacaaacccacaatcagatgtctttcctaaagggtattatgccgtggctgtggtgaaggcatcagactccagcatcaactggaacaacctgaaaggcaagaagtcctgccatactggagtagacagaaccgccggctggaacatccctatgggcctgctgttcagcaggatcaaccactgcaagttcgatgaatttttcagtcaaggctgtgctcctggctataagaagaattccaccctctgtgacctgtgtattggcccagcaaaatgtgctccgaacaacagagagggatataatggttatacaggggctttccagtgcctcgttgagaagggagacgtagcctttgtgaagcaccagactgtcctggaaaacacgaacggaaagaacactgctgcatgggctaaggatctgaagcaggaagacttccagctgctgtgccctgatggtaccaagaagcctgtaaccgagttcgccacctgccacctggcccaagctccaaaccatgttgtggtctcacgaaaagagaaggcagcccgggttagcactgtgctgactgcccagaaggatttattttggaaaggtgacaaggactgcactggcaatttctgtttgttccggtcttccaccaaggaccttctgttcagagatgacaccaagtgtttgactaaacttccagaaggtaccacatatgaagagtacttaggagcagagtacttgcaagctgttggaaacataaggaagtgttcaacctcacgactcctagaagcctgcactttccacaaaagttaaaatccaagaggtgggtgccactgtggtggaggaggatgcccccgtgatccatgggcttctcctggcctccatagccctgagcggctggggctaactgtgtccgtcttactgcttggtgttgttaccacatacacagagcacaaaataaaaaatgactgttgacttt

SEQ ID NO: 128 - DNA, 1140 bp, Rattus norvegicus
ggatcctaacttcttcccaagcaccagtcactggagacataggagaggcaagaagcctctgggcaactgataaggattccccgcacccaggggaggcgatccccaagcccagcctctcagggtcctgacaagccatgctgcggagagcaatcacaggccagccaatgacagctgctccaagggcgtgtccttacctcctgcacatataaatgaaacttgctgcggggccaatacattctcattctgatagactcaggaagcaatcatggtgctctctgcagctgacaaaaccaacatcaagaactgctgggggaagattggtggccatggtggtgaatatggcgaggaggccctacagaggtaacatcaggaccctgttctttaaggacagcaggatccaaaccggaccagggactcagtgggtagctcctaagtgtgctttcccgtggcctcaacttatctctccttctcacaggatgttcgctgccttccccaccaccaagacctacttctctcacattgatgtaagccccggctctgcccaggtcaaggctcacggcaagaaggttgctgatgccctggccaaagctgcagaccacgtcgaagacctgcctggtgccctgtccactctgagcgacctgcatgcccacaaactgcgtgtggatcctgtcaacttcaaggtgtgagctcagacctggcagggggcacctgggaccttcaaggatcccttggggcagtggtgaggggcacagggggagggggaaggggttcctcatgcccagggcagggaacacagtgttccaggaaggggagcttacccagcagggtgtctactactagggactgacccttcctgtctctgcagttcctgagccactgcctgctggtgaccttggcttgccaccaccctggggatttcacacctgccatgcacgcctctctggacaaattccttgcctctgtgagcaccgtgctgacctccaagtaccgttaagccacctcctgtcgggcttgccttctgaccaggcccttcttccgtcccttgcacctgtctttgaataaagcaaaagtaggaagaatcccgtgtgcctgtttctcacatgtgcaaaggtgacaatgtttggtatgggaaaatcctcc

SEQ ID NO: 129 - DNA, 4409 bp, Rattus norvegicus
ccacgcgtccgatggggaagaagcagccgagggcagcagcaagtgctgctccaaactgtgagctaaaatcctattctaagagcacagatcctcaggtatctaccatggtgttggatcctgaagaaaagattccagacgatggtgcttctggggaccatggagactcggccagcctcggtgccatcaaccctgcttacagcaactcttccctcccacattccaccggggattctgaggagcccttcaccacctactttgatgagaaaatccccattcctgaggaggagtactcttgttttagtttccgtaaactctgggccttcacaggacctggttttcttatgagcattgcctacctggatccaggaaacattgaatctgatttacagtctggagcagtggctggatttaagttgctctgggtgctcctgctggccactattgtggggctgctgctccagcgtctcgcagctcgactgggagtggtcaccggcttgcaccttgctgaagtgtgtcaccgtcagtatcccaaggtcccacggatcatcctgtggctaatggtggagttggcaatcattggttctgatatgcaggaagtcattggctcagccatcgccatcaatctcctgtctgccggaagggttcccctgtatggtggagtcctcatcaccatcgcagatacttttgtatttctctttttggacaaatatggcttgcggaagctggaagcattttttggctttctcatcactatcatggccctcacatttggatatgagtatgttacagtgaaacccagccaaagccaagtactcaggggcatgttcgtgccatcctgttcaggctgccacacccctcaggtggagcaggcggtgggcatcgtgggagctgtgatcatgccacacaacatgtacctgcactctgccttagtcaagtctagacaagtgaaccgggccaataagcaggaagttcgagaagccaataagtacttcttcatcgagtcctgcattgcactctttgtttccttcatcatcaatgtctttgtcgtctccgtctttgctgaagcattttttgagaaaaccaatgagcaggtggttgaggtctgcagaaatagcagcagcccccatgctgacctctttcctaacgacaactctaccctggctgtggacatctacaaagggggtgttgtgcttggatgttacttcgggcctgcggccctctacatctgggcggtggggatcctggctgctggacagagctccaccatgactggaacctattctggccagtttgtcatggagggattcctgaacctaaaatggtcgcgctttgcccgcgtgatcctgaccaggtctattgccatcatccctaccctgcttgttgctgtcttccaagatgtggagcatctgacagggatgaatgatttcctgaatgttctgcagagcctacagctcccctttgccctcatccctatcctcaccttcacaagcctgcggccagtgatgagtgagttctccaacggaataggctggaggatcgcaggcggcatcttggtccttctcgtctgctccatcaacatgtactttgtcgtggtctacgtccaggagctagggcatgtggcactgtatgtggtggctgcagtggttagcgtggcttatctgggctttgtgttctacttgggttggcagtgtttgattgcgttgggcctgtcgttcctggactgtgggcgctcggtaagcatctctaaagtcctgctgagcgaagataccagcggtggcaatactaagtaaacactgggtcagcctgtctgtctgtctttgcagggagccatcagagccagtgtgtttctatggtttactgtgtgaacatagccacaagtatgtgccgttgcacagactgcatttagggaccaactgttagttgggaaacactggggtgggtgtgtggtgtgtgtgtgtgtgttgtttccttctgtctttgtcaaatagcatgctgctattaaatgcttggtggcctaaaactctgtgtagcctaggctgccttcaaacttacagcaatcctcctggctcagcctcctgggtgctgggattccaggcatgtctaccgctcctggctgtcacgagtgcttacaagatgactggttttgtcaggggaggtcttaccctgtagcattaggcagcaccttgaaaaggtgagccttgagctgttttgaacactaaattcctaaatagctgtccaaggccatggctcggttttagttctgagaaacccaaccagactgttgtcatcatttgaattgcagaattagagaccgctatttttgagttcaggatttctgtttgtttggtgcatttcattttgtttttcaagacaagggtttcttccttgttgtcctggaacttactctgtagaccagcctggctttgaactcacagagatcctcctgcctctgcctctgcttcccgactgctaggattagaggcatacaccaccactgccctgctaagctcagagttttttatttctactttggaattcctcagtggaaagaaaggtagagcaggagagggggtgtggtcaagtgatggctcccctccaggtccttgcaggtttaccttaaggagtggagcttagcagggcttcatctgtagtcctgaggctagtgacttccctgttaatagcaagcatcccgatagtgtttcatctcgagtacacacagtcctggaatctccgccttcctctcctgagagagtgcggatggcaaaagactactgtagcacttgtgaactggctcacagcaaatcccagagctgaccgcactactcccgaaagtacccttcaccaaatcttggctctgacccaccgctgtttcatgcccaagataactcagaaggcaacctcaggagctctggacccaaaccttgcaaagtcagtagttgtcactgtgatgcaaagtcctctccctgcaaggtgggactaggctgcctcctcacagcccttccctcggagagaaagcctcttgagaccaggctgcggagctctggagattcagcacgggactacagaactgctgctctcagttcagccacttctgtcctggcacgtgggagacatgattctgtcacatcaagtcctgtctgtttgctggaaaggaataatacaagtttgtataatcattgccttggtggcaacaggagctacagtgacttcgaaggatgtcgtcctctttgccgctttcccagttcgactgtcccgacaaatgacctgcattgtggtgccactgtggcattagtgctagcatttcacacagtcagaagctcagcctgcatagagtcctgtgaggcatgaagggtaaatgcagtttcactcagcctggttgacctcagccccacagctaacacaacacagtcaggccgcgggtccctcactgcggcattctcaacccctgggttgccacccatttgcagcccctatatccaaaaccatttacattatgatttataacagtagcagcattagttgtgaaatagcaaagattttatggttgggggttaccaccacaaagggtcgcagcagcaggaagtttgagaaccctgcaccacagggtccatctcacacctgcctctgccaccattgttcccaaaactgactggaaactgagcttttgaaactgtctcgatgtggtgcttgagggccagattgacagtagcagaattactggaatggatgctctagtgacatctgcatttgtacaggggcggggttgggcggggcggggcggggttgggcagggtgtgttcagagtcactgtacttacagtccagcccagagctgctggcagtcatgcccaggggtctgccttgtgcgtgctagcaaggctgtgctgcagatctcacttcctgccccagagttctgctgtagtatgttcgtttacagtgatagacggttccattgtgtacgacggtctctgactctatgcctacagtatttacagtgtcaaagattaaaagtgtcgcctgtccatttggccgtcactgggaaacagtgcttccaacagtgctctgtacgtaacctgtaagcatttcaaccccgccacgccagtgtggcctggcgttacgttggcgagccatcttgtacgttctcacttggtcctcgttcttctgcgacctgaaatagttgttccctctgctctgggagctggcggctggggaacagcagcagcttgtcttgtaaggtcctgccaggagggcaacaagtgactataaggaggctgttagtgagcctctgacagcttgtgaacttgctgtaattaaaacaaaaacttccctgttaaaaaaaaaaaaaaaaaaaaaaaaaaaaaaaaaaaaaaaaaaaaaaaaaaaaaaaaaaaaaaaaaaaaaaaaaaaaaa

SEQ ID NO: 130 - DNA, 591 bp, Rattus rattus
caagaaggaaaaccgagttttattggaggtctgagcagcaaggggtgtccgagaagcagggctgatgcaggggacgctggaggtggtcacaggcgagcagctgggtggggagaggtgtcaggtgccaagggggctctggctgagtttcctggagccaggtggaggttctaccgcctgcgggtggacagacggcggatggagctgcggaaagttccctcctcttcgtcgggttccccagttctctgctgttggttgaatttgcaccggcatcttttgctaaggatgataaggatgcccaagatgaagaggatcccagcgatagtgaggccgccgatccgcagggtgtggtaatcgtaggtgaatggatctggttcctgcggagcttctgcactggccatggagaggagacacacacagacaatcaggatgtggccgggagatgccattgccccttgaaagggaagcaagctatctccggacacaggtggaatgctgtgagacaaacaggacatgcccagcctcacctgcccctacacacctcagccagtggtctctccgtactcaggcagtcccagttctcctgccctcggc

SEQ ID NO: 131 - DNA, 1330 bp, Rattus norvegicus
gggactctctcatgccgccatacggagatggctgttttgggtgcccctggtgtgctctgtgacaatggagcaactgcagagagacctaccctggaccaccactgggatctctggaagaaaactcgcatgagaaggaatacagatcagaatgaagaagacgtacgacgtctcatctgggaaaagaatctcaagtttataatgcttcacaatctggaacattctatgggaatgcattcatacagtgtgggcatgaaccacatgggagacatgacacctgaagaagtcataggttatatgggctctctgagaattcccaggccctggaatagaagtggcactctcaagtcaagctctaatcagacattgcccgactctgtggactggcgagaaaagggctgcgtcactaatgtgaaataccagggctcttgtggttcctgctgggctttcagcgccgagggggcccttgaagggcagctgaagctgaaaacggggaagctggtgtctctcagtgctcagaacctggtggattgctcaaccgaagaaaagtacgggaataaaggctgcgggggtggcttcatgaccgaagctttccagtacatcatcgatacgagcatcgactcagaagcttcctatccctacaaagccatggatgaaaagtgtctctatgacccaaaaaatcgagctgccacgtgttcaaggtacattgagctccccttcggcgatgaagaagctctgaaagaagcagtggccactaaagggcctgtctctgtgggcatcgacgacgccagccattcctccttcttcctctaccaaagtggtgtctatgatgacccctcctgtaccgagaatatgaatcatggtgttctcgtggttggctatgggactcttgatgggaaagactactggcttgtgaaaaacagttggggccttcactttggtgatcaaggatatattcggatggcgagaaataacaaaaatcactgcgggattgctagctattgctcttacccagaaatctaaaccgtttcttctttttctaatgggtcacaaagacggaatacactctaatttaattttgtctgctccatccggaggacccaagtgtgtcgtgatcagtgtgtacatactgtgctaactggcttacagcttgtttgttttataactttacctctctctgaaaagtctgtaagcaaggacgcgctgaggatggagctggcagtctgtcctagatattctttctatgcttgcaccctgtcgtctaatgtgtctaataaccctttgtaacacagatatccccaaagtgcctaataaaatctgtcatttcaagctc

SEQ ID NO: 132 - DNA, 554 bp, Rattus norvegicus
ctttccgccggggcagccatcttccagtaactcgccaaaatgacgaacacaaaaggaaagaggaggggtactcggtatatgttctctagaccttttaggaaacatggagtcgttcctttggccacatacatgcgaatctacaagaagggtgatattgtagacatcaagggaatgggcactgttcaaaaaggaatgccccataagtgttaccatggcaaaaccggaagagtctacaatgtcacccagcatgccgtgggcatcattgtgaacaagcaagttaaaggcaagattctggccaagaggatcaatgtgcggattgagcacatcaagcactcaaagagcagagacagcttcctgaagcgggtgaaggagaacgatcagaagaaaaaggaagccaaagagaagggcacctgggttcagcttaacggccagcctgcgccacccagagaagcccactttgtgaggactaacggaaaggagcctgagctgctggagcccattccatacgaattcatggcctaatgtatacaaaggaaataaagaacccgaactgc

SEQ ID NO: 133 - DNA, 476 bp, Rattus rattus
ctgggcatgacatttctactcctgcatcttctcgatagtttcttccttgtatttgcccttctcctttcctacttgccgggacttggctttcctctccaggatcttcttgcggtccttgtccagctttagcctggtgataaccaccttgctggggtggatgcccacatggacagttgtgccgttagccttctctcgctggactcgctcaatgtagatgacgtatttcttcctgtacacttggaccactttgccaatctgctggcctttgtagtgtcctcgaacaacctgaacttcgtcgtcctttcgaatgggcatagaccgaacattatacttctgtctcaattctttggaaagcggctaagacatgatcttcctccgaatgtgagatggtgcattgaaatgccgtttgcggttcttgcttcggtcagaagtcacgaagggattgaacttcattttggcggctgcaatccagcgat

SEQ ID NO: 134 - DNA, 466 bp, Rattus norvegicus
ctttccgtctccggccgccgcaggagaggagtcgccgccatgtccgcgcatctgcaatggatggtcgttcggaactgctccagtttcttgatcaagaggaataagcagacgtacagcacggagcccaataatctgaaggcccgaaactccttccgctacaacgggctaattcaccgcaagacggtcggagtggaggcctggcctgatggcaaaggggtcgtggtggttatgaaacgcagatccggtcagcgaaaacctgccacttcctacgtgaggaccaccatcaacaagaatgctcgggctaccctcagcagcatcaggcacatgatccgaaagaacaagtaccgccctgatctgcgtatggcggccatccgcagagccagtgccatccttcgaagccagaagcctgtggtggtgaagaggaaacggacccgccccaccaagagctcctgagccccacaccccg

SEQ ID NO: 135 - DNA, 591 bp, Rattus rattus
cttttgtgagtggcagtgaacgagcacgcactgctatgaaggcgtcgggcacgcttcgggagtacaaggtggtggggcgttgcttgccaaccccaaaatgccacacaccgccactgtaccgaatgcgaatctttgcacccaaccatgtggtggccaagtcccgcttctggtactttgtgtcgcagctgaagaagatgaagaagtcatccggggaaattgtgtactgtgggcaggtgtttgagaagtcacccctgcgtgtgaagaacttcggcatctggctgcgctatgattcccgaagtggcactcacaacatgtaccgagagtaccgggacctgaccactgccggcgcggtcacacagtgctaccgagacatgggtgcccgacaccgtgcccgtgcgcactccatccagatcatgaaggtggaagagattgcagctggcaagtgccgccggccagctgtcaagcagttccacgactccaagatcaagttcccattgccccaccgtgtgttgcggcgccagcacaaaccacgcttcaccaccaagaggccaaacaccttcttctagacaccagagacccactgaataaaag

SEQ ID NO: 136 - DNA, 4207 bp, Rattus norvegicus
ccgggaggcgcggtcgtccctccgcccgcgcgccgggggccggccctgtcgcctgcgcctttttcccccgcgcacaccgcggcggcgcgcggccactcgccaaccgcaaagagcgcggtggctgcagcgccctgcgctcggaagatggtccccgcggccggacagctcgctctgctagcgctgggtatcctggtagctgtgtgtcaggctctggagaacagcacgtcccccctgagtgactcacccgtggcggctgcagtggtgtctcacttcaacaagtgcccagattcccacactcagtattgtttccatgggacctgcaggtttttggtgcaggaagagaagccagcatgtgtctgccactctgggtacgtgggtgttcgctgtgagcatgcagatctcctggcagtggtggctgccagccagaagaagcaggccatcactgccctggtggtagtctccattgtggccctggctgtcctcattatcacctgtgtgctgatccactgctgtcaggtccgcaagcactgtgagtggtgccgtgccctcgtctgcagacacgagaagcccagcgccctcctgaaaggaaggactgcctgctgccactctgagacagtggtctgaagatcccagaggaggaatttggccaggtggccgatgacagcccaaccaaggaaaggtgtctcaggacaacaccaccagcagtgcccaggccccgggacatgctgggagaccttccccctcaatgtacaaccacctgggcagctctctgtcctttacgagcttcaaaactgtgtgataaagggtgcccagcgggcaccctagagaagaggccagtagacaacatttgaacgacaagttgaacaagaacctcaaagggctggccttcttgctaacccacaccaagaaggctgtccgtggactccaaactgtttcttctccatgggccgtctaaccccccacagagactccacgcttggtgtacaaaatggacaaggggaaacatctattgtcctttgaagacaccatggccccggcatgagccctgacatctcctcaaacggttgccaggatgatgtgtcttatgtattaggtggatgacgcggttttgtttgtattctctttatgtcagtatcgggcatccatgttaatgatccacgagcggctggctgtgaagttacaccaaatagaaatgttcagccactttgataaagtaaggctgtggggatgggagcctcccaggggctgtagagacagaactcaaaagtgcattctgctgggaaccaaactgctaccaggaggttgtgcccactaagacaggaaagtccctggatatatgctgtggcaaagttagcaagggcaagaggacaagagagcctgtgtgggcactgagggaggacgcacattccatcactcgattaagttggattagcctcctcgtgagcccagctccagcatcagccatgagccgtgggccaaatccgtgaaggtgaccccctctttattggtttctgctcatttttagaaggagaaatttacctttcctatttattttcaagcattaagagaaatagcccccctgtcttgttttgttttgtttcccctttcagaatgttggcattactaatgaaatcgctaccaagcctctccactcccctccggggaaggagctatgttccctgagcactggagggcgctctgacccattgagcccacctcctccctgtgctgctcaggactgtcaggagacagtaaatacatccagctgcttgtggaggaggccattctccaactcagaacttaaagggccctccaccctccagagcctttaacgtaacgtcaggaaaaggggtgtttgacataccaaattctcagcaagttctgcctgttcctcattcttctccattccacctttctctgtgaatgttttcttttctcatatgacctagatatcaatctgcccaggtcttaaccctggctccctttgttaacaatgcctcaagctccacaagaagaaagtgggttggttcagtgctgacctctaactactcagtcgacgtggctccaggcggaaatcgtcacttgtgttgttattattattattattttggtttgatgttttatcttgttttgtgagacaaggtcttgctgtgtagcccaggttggccttgaagttaagatctgcatgctccagcatcctgagagctgggcttactggtgtacagcaccgcacccagcagagtctttacggttattaaagaagacaggttaagtttgctttccttgggtcgtgcatgtgggtcaaggccaagtgtagcctgctgctcagacacccatcgacctcactggacgttggccctctattgggcccccaatgcagaccctgtatgaagtactagctcaccagggccaacacaaagggaggggcttgttttaatttagttcacaccgttagcttccgatgataagtctttcctggtctgttggaagctcctgggtgtctgacttcttttaaagagtttgaactgatatcaaaatatcattgggaatttcttcacctagtgtcccatcctgaagatattaccatgcaagactcagcagaggtgggaaaagttagtacaaacctttaatggtggaggcagaggatcttgggaggacctcagctttagtgtctgaacattccggttctcaggtccagccagtcacagcagccagtaccatcccagtacccatacacagatgcagccggctcaaacgtctcccagaagtgccttccccaccagtcataccctctgaagagtcagaagctgagactaagttgaggcaaatctggttggacatcgtcctgccctgacataagacagccctgcttctttggtgactctgattcttggaagtcagacaaatgctgacagcacaaatctcacagcacagttagacctgggtagctgtcccagcacctcctgtcaggtcacactggccctcttgatactcagtgcagctactgagtcaggagcactcgtcagcagacacacaggtcagtggacagtgactcagaggactgtgaacattcccattaaatggattgaaattaattctggagtcattaagagagctcagttaagaatggcacttaccaatatccctgagaacatgagttcaatcccctgggacccatctggtggaaggagagaaccaacttgcccaggatgtcttctgaattctacatacacaacacacacacacacacgcacacacacacacacacacacacacccctctagctgtaactttaaacacatgatgggacatgttctctccatgcaaaactacaatggggactcagtctgaaagatagattctaggtggacatacgcagacccaaaccataagtcagtttgtcatgtgcccagaaaaaggtggtaacaatagtcccaatgtcctttttctcctaaaaaggttgtggggaggcatggttggtacccacccacccacactggtgagggaagtgactgtgtccctgagtcttagatggtgatgttgttccctgcaagtccccaggccaggtttcctagtgcctgtgagccactaggtggaccggcaacacgctgacactgcctacaggccccagtcccatggtgaatagtaaggttacctctctcaaaggccaaggggaggccacatgagacaacacgtttttcacacagggtttcactgtatagcccaggccagcctcaaacccatgattcccctgcctcagcctactgggttacaggtgtgcactgccatacctggctcacgtttgttttttaatgttctggtgtaacatgtattccctgaagccattgatctatctcaaagacacagtgttgtacgcatacatgtgcgcacgtacacacaccaaactggaaagcgacccctctccatagtgtgataagtttattataagtttattataaggaccctatgctgtttttagaactcatctttctgacttctgtatatgatgcactgaaggttaatatgtaatattttaatttattttatgtggtaagttaattttggttttctgtaatgtattaatgtgattagaagcttttttccttaatatctgaattatacttaaagagtagtgaggaatataagatactgttgtgtattgtaccttgtttggaaggatgaaggaatgaacccttttttttttcct

SEQ ID NO: 137 - DNA, 490 bp, Rattus rattus
gacttttgaaatcagatttactcaggggtggctggatttgggggtgggttccaatccatcgttgcctggcccgtgtcaattactaacaaaggtcaaatacaatatgtcagacctaaagccacagaaggagggtgtaaaacgttctgttccggagagaagaactagaggtcaacgacgtgggacttcacctagagtttagcctattaaattagtagtaacaaaacaacacatcggggatttaaaataacacctggtagttccttccaacatacacagaaatagcatcagagaagcttttgaataccacctaactgcattatggccttataggtcgaaggaaccaatgaaaataatggacctccattccacaccccatccttctccctctacatcaaacctacgcccgatttcgagtgagagttttaagtgtccacatttcttaagccacatttcgagcaaatcacgtcaattttggatgcttgtcttcatc

SEQ ID NO: 138 - DNA, 630 bp, Rattus norvegicus
tcttccggtcccaggcgctcggggagccgcggcttaccgtgcagacatggccaagtccaagaaccacaccacacacaaccagtcccgcaaatggcacagaaatggcatcaagaaaccccggtcacaaagatacgaatctcttaaaggggtcgaccccaagtttctgaggaacatgcgctttgccaagaagcacaacaagaaaggcctgaagaagatgcaggccaacaatgccaaggcagtgagtgcacgagcagaggccatcaaggccctcgtgaagcctcaggctgtcaagcccaagatgccaaagggctccagccgcaaactcagccgtctggctttcatcgctcaccccaagcttgggaagaagattcgaagctacatggccaagggtcgtaggctctgccaaccaaagcccaaggttcaaaccaaggcagaggccaaagctccagctaaggcccaggccaaagctccagcccaggctcccaagggtgcccaggcccctgtgaaggccccatagaacaggctcctgccagtgtgaagacagacagactgctgtgacacacccacctacacactatctgcagatgaccagtgtcctatgctgtttttacaaataaacttgagacaaga

SEQ ID NO: 139 - DNA, 664 bp, Rattus rattus
ctttcggttcggaggaggcaacggtgcaactttcttcggtcgtcccgaatccgggttcatccgacaccagccacctccaccatgccgcccaagttcgaccccaacgagatcaaagtcgtgtacttgaggtgcaccggaggcgaggtcggcgccacatccgccttggcccctaagatcggtcctctgggtctgtctcccaaaaaagttggtgatgacatcgccaaggctaccggtgactggaaaggcctcaggattacagtgaaactgaccatccagaacagacaggcccagattgaggtggtgccctctgcctctgccctgatcatcaaagccctcaaggagccaccaagagacaggaagaagcagaaaaacattaaacacaatggaaacatcacttttgatgagattgtcaacattgcccggcagatgagacaccggtctttggccagagaactttctggaactatcaaggagatcctgggtactgcacagtctgtgggctgcaatgtggacggccgccaccctcatgacatcatagatgacatcaacagtggtgcggtggagtgcccagctagttaagaagcaacgagaaggggttgggaatttagctcagtggtagagcgcttgccaagcccaaggccctgggttcagtccccagctccgg

SEQ ID NO: 140 - DNA, 429 bp, Rattus norvegicus
gtgaggcgaagctgagcaggaatggccctgtggacctctgtgatgggacatctggtggaatctcacaggcagttctgtggcaaagatggatgaaagctaaggactcatgaggaagctggataactgaacaaagccatgtacaagaatgggaagccagaaaatgggatggtggagtttgaatcaggtggacagttctaaaagtacaaatgatttcgtataaaggtaccacatgtgggtccctttaactgaaggcatggcaagctccacacaaggtccttcatttctgaatttcaagggctcctctgacaagtggacagtgcagtgggtgcaccttttccagaggtgactggatggatgcttgaacagaagatttgccaaatagacattgtgctgtcaagaattttaccattaaaagtgcattattgtagc

SEQ ID NO: 141 - DNA, 460 bp, Rattus rattus
gatcagatgataaatcagcttcaacagcccatgcctacagcccttgcagcaaatagctgtacacagccttgtcccttctgtccccgtctccatccccaggagcattaaggcccagctcttcccctccctccctctgctcctgaccttggggcctggaagggatgggcaagggagcgaaggtttactagagaaaggtggggtgaacgaagggtctgggttggagaggaggactggggttcggaggaccctcaggagtggctagaacacagctctaccctgggctatgctgcaacagaagctgtccatcccagccaccagacccaagcttaaaaccagaactgaccactctaagatctggaccactgatccatgtcaatgcttgttcaaggtattcattaggctctcccttgcccatggaacagggaacttgaggtcaggcaacctttaaattggggggccc

SEQ ID NO: 142 - DNA, 1595 bp, Rattus norvegicus
ctgggagcagttcggtccgatgcattgaaacttaatttgacagattcaaagggtacttgcctttatgcagaatgggagatgaatttcacaataacatatgaagctctaaaagtcaatgaaactgtaaccattacagtgcctgacaaggtgacatacaatggaagcagttgtggcgatgataagaatggtgccaaaataatgatacaatatggatccactctctcttgggctgtgaatttcaccaaggaagcatctcagtattttattaacaacatcacgctttcttacaacactaatgataccaaaacatttcctggtgctgtacctaaaggaatccttactgttatcattcctgtgggatcccagcttccattgggtgtcatctttaagtgcagtagtgttttaactttcaacctgagtcctgttgttcagcactattggggcattcacctgcaagcttttgtccaaaatggtacagtgagtaaacatgaacaagtgtgtaaggaggacaaaactgctaccactgtagcacccatcattcacaccaccgtgccatcgcctactacgacactcactccaacttcaatacccgttccaactccaacggttggaaactacaccatttctaatggcaatgctacctgtctgctggctaccatggggctgcagctgaacatcaccgaggagaaggtgcctttcatttttaacatcaaccctgccacaaccaacttcaccggcagctgtcagccccaaacagctcaacttaggctgaacaacagccaaattaagtatctcgactttatctttgctgtgaaaaatgaaaaacggttctatctgaaggaagtgaatgtcaacatgtatttggctaatggctcagctttccatgtttcaaataacaaccttagcttctgggatgctcctctgggaagttcttatatgtgcaacaaagagcaggtggtttccgtgtctcgaacatttcagataaatacctttaacctgaaggtgcaaccttttaatgtgacgaaaggagagtattctacagctcaagactgcagtgcagatgaagacaacttccttgtgcccatagcggtgggagcagccctgggaggagtacttattctagtgttgctggcttattttattggtctcaagcgccatcatactggatatgagcaattttagcacctacaatctgattgaatatattacaaaatacatacaaataacaaagttgtcttacctgtcagtttatgaaacactttgctacttaagacagactccttggaacttttatttggaaatcagtccccacaatttgagataaggctttttttgaaaaaaaaacaaaaaacaacaaaaaaacaaaaaacaaaaaaatcattctctgatctgcttaaaatgcagactggctttaaaaaaaggagaaaatgaatacacgtgtgtgatgttttaaggtctgtcttaagaagctttggccaaattgggatcctaacctaaatgccttaaacttattaacatgaccgttataagaaaagatatatggagttgtatcttactggaattaataaacactgcttcaccaaaaaaaaaaaaaa

SEQ ID NO: 143 - DNA, 487 bp, Rattus norvegicus
tttttcccagcagccgccaagatggccgaagtggagcagaagaaaaagcgaaccttccgcaagttcacctaccgtggcgtggacctcgaccagctgctggacatgtcctatgagcagctgatgcagttgtacagcgcccggcagagacggcgcctgaaccgaggcctgcggaggaagcagcactcactgctcaagcgcttgaggaaggccaagaaggaggcgccacccatggagaagccggaggtcgtgaagacccaccttagggacatgatcattctgcccgagatggtcggcagcatggtgggtgtgtacaacggcaagaccttcaaccaggtggagatcaaacccgagatgatcggccactacctgggcgagttctccatcacctacaagcctgtgaagcacggccggcccggcattggtgccacccactcctcccgatttatccccctcaagtagtggggacaataaagactcgttttcagcc

SEQ ID NO: 144 - DNA, 352 bp, Rattus norvegicus
tttttttttttttttttgccaaaagcagaatctctttattatcaaacagtagcgacagatcaacctgtcactgtcacacacagactggggacagtgaaaatgttactgctttgcagcttgctgcttgcagcctctgtgttcagcgggcagtctctgatctggaactgggcttcattctcgttgggaatgtccttccatgtggccaggaacatctgccggtccatcttcccgtcctccacgaagaggacatgcagtgggtaaaagtgctgaagtagaagacgtcaatgttgttcttcacagccacctgaagattgttcagaggctccatcttcatgactgagcccaccgtgtt

SEQ ID NO: 145 - DNA, 644 bp, Rattus rattus
attatgaatgacattttattcagtcattttctttacaactgaaactctgggaattcaaagttaacatccttgcctgtgagcttcttgtacacgccagaaaaagtttcgaccttatgctccacgttgttctgctgtgctttgtctaaatgaacttttatgagccggctgccatccagtttcacacggatcctcttgcccacaatttcacttgggaagaccaaatcctcaaggatggcgtcgtgcactgctgtcagggtgcggcttctggggcgcttttgcttatttttcgtacggctttttcgggttggcttgggcagaatcctcctctgagcaatgaagactacgtgtttcccactgaactttttctccaattcacgaactagccggacttggattttctggaaagatttcagctgaggaactggtacaaaaattatgatggcttttcgaccaccaccgacttcgatttcctttgccgcggtgatgttgagttcccgcagctgcgccttcagatccgagttcatctccagctcgagcagcgcctgagagatgccagactcgaactcgtccggcttctcgccattgggcttcacaatcttggcgctcgagctgaacatggcttcgtccttacggagcctcgtgcc

SEQ ID NO: 146 - DNA, 1871 bp, Rattus norvegicus
gttattctcgtcctgactactttccaagtgccactggtaattgtgagttttggacagtccaagttatatcgcagtgaggattacggaaagaattttaaggacattacgaatctcatcaataacaccttcattcggacggagttcggcatggctattggtcccgagaactctggaaaggtgatattaacagcagaggtgtctgggggaagccgaggaggaagagtgttcaggtcatcagactttgccaagaactttgtacagacagacctcccctttcatcctctgactcagatgatgtacagccctcagaattctgattacctgttagctctcagcactgaaaatggcctgtgggtgtccaagaattttggggaaaaatgggaagaaatccacaaagcagtatgtttggccaaatggggaccaaacaacatcatcttctttaccacccatgtgaatggctcctgcactgatcttggtgccctggaattatggagaacatccgacttggggaaaaccttcaaaaccattggtgtgaaaatctactcatttggtcttgggggccgtttcctcttcgcctctgtgatggctgataaggatacaacaagaaggatccacgtgtcwacagaccaaggggacacatggagcatggcacagcttccctctgtgggacaggagcaattctattctattctggcagccaacgatgacatggtgttcatgcatgtagatgaacctggagatactggatttggtacaatctttacctctgatgaccgaggcattgtctactctaagtctctggacagacatctctataccaccacaggcggggagaccgactttaccaacgtgacttccctccgtggagtctatataacaagcacactctcagaagataattccattcagagcatgatcacttttgaccagggaagaaggtgggagcatctgcagaagccggagaacagcaagtgcgatgctaccgcaaagaacaagaatgagtgcagccttcatatccatgcttcttacagcatctcccagaagctaaatgttccaatggccccactctccgagcccaatgccgtgggcatagtcatcgctcacggtagtgtgggagacgccatctcggtgatggtcccagacgtgtacatctcagatgatgggggttactcttgggcaaagatgctagaaggaccgcattattataccatcctggactctggaggcatcatcgtggccattgaacacagcaaccgtcctatcaatgtgattaagttctccacagacgaaggccagtgctggcagagctatgtgttcagtcaggagcccgtctacttcaccgggctggcttccgagccgggagccaggtccatgaacatcagcatctggggattcacggagtctttccttacccgccagtgggtctcctacacaattgatttcaaagacatccttgagcgcaactgtgaagagaatgactataccacatggctggcacactccactgaccccggagattacaaagatggctgcattttgggctataaagagcagttcctacggctacggaagtcatccgtctgtcagaatggtcgagactatgttgtggccaagcagccatccatctgtccctgttccctggaggactttctctgtgactttggctacttccgtccagagaatgcctcagagtgtgtggagcagccggaactgaagggtcatgagttagagttctgtctgtatggcaaagaggagcacctgaccacaaatgggtaccggaaaatcccaggagacagatgccaagggggaatgaatccggcccgagaagtaaaagacttgcagaagaaatgcacaagcaacttcttaaaccc

SEQ ID NO: 147 - DNA, 589 bp, Rattus rattus
tgggatgttaactcttttattaactcagggttaacattagatttgcttcactgatttcttatttgaagttgtggattcaacagacaacagctgagtccttgccacttacaggtgacaagacaaaacacattatattcagagaggagagcaggaccatatggagagagacgaggttggaaaaatttaaggcaaatgttattcccacgttaaagggaactggaccaagcagatctgcgcatttcaatgaaaatatatgaaatatttgtcaaaataattaacatcggtaaaaattagaacacgtagcttataaaatgcccacacaggcttggcagaaaaatcaatccagctctatcaacgtaggcttgtactatactgggccagagcagtgtccacccgagaacagagtcctgagtgtggaggccaaatgcacttgagaagcagttgtgtgccatggagggctggcgattagtgatttggggctggctttgcataaggaggaactgcttggccattagaggtctttcggctagccttaagtagctcctttggacccttctccacaggctctgtatctgtagatcctcgtgcc

SEQ ID NO: 148 - DNA, 481 bp, Rattus rattus
gccatgccacagcaaggggcctttattagatgttcagggcacagacaggcaggtggatgctagatggtgtagcacaccttctcggggtggagtggtgcctggatgtccagtttgtgggtcttgctgtccttatcaatgatctccagtcgcagtgtaggcggacgcttttcagcctggggcgagggcagctcagggctcttgaggagctgcttgtctgagtcctccacagtgatacgcagggtgcagccccctggtagcaggtcctgctcataggctgccgccagctggtttaccacacggcgctctacctcatgcttaatggagcgggcaccatagtggacgttgtagccatcaaccaacacgtctgccacctcgcggtcccacagtagtgtgatgttgtgtctctgcttggctctcttggcccagaagttcagttccttgttgaccagctggatgagctccgagtggcacaaagggagga

SEQ ID NO: 149 - DNA, 786 bp, Rattus norvegicus
atgtcttacactccggggattggtggggaccctgcccagctggcgcaacgcatctcctctaacatccaaaagatcacacagtgctccgcggaaatacaaaggactctgaatcaactgggaacacctcaggatacaccggagttgaggcaacagctgcagcaggagcagcagtatactaaccaacttgcgaaagaaacagataagtacattaaggagtttggctttctgcccaccacccccagtgaacagcgtcaaaggaagatacagaaagaccgattggtggcagaattcaccacagcgctaacaaactttcagaaagtgcagaggcaagctgctgagagagagaaagagttcgtggcccgagtgcgagccagttccagagtatcgggtggctttcctgaagacagctcaaaagcgaagaattttgtatcttgggaaagccaaacacagcctcaagtgcaagtccaagatgaagaaatcacagaggatgacctccggctcattcatgagagagagtcttcaatcagacagctggaagctgacattatggacattaacgaaatattcaaagacttggggatgatgattcatgaacaaggagatgttattgacagcatagaagccaatgtagaaagtgcggaagttcacgtacagcaggcaaaccagcagctgtcaagagcggcaaattatcagcgcaaatccagaaaaaccctctgcatcatcattttaatcctggtggtcggaatcgtgatcatcttcttcatcgtatggggtctgaaaggctga

SEQ ID NO: 150 - DNA, 403 bp, Rattus norvegicus
tttttttttttttttttcctgtagacggcttattttattgctctttattttggctcttcccccagacactcctcagactccatcttggctttttttccaggaagttcatatgtgaaccacctgtgtgcagaagcctatggaggtcagaggagagcatcggaccccctgggactagagttatagttggttgtgagccaccaactgggtgctgagaactgaacccaggtcctccgcaagagcagcaagtgcttttaaccactgggccatctctccagactctcaaacattgatttatgtctatgggtttgtgcacatgcgtgaagtgccctcagagaccagaaaagggtattggatcctctggatctggagttacagacagccgtgggtgttgggaactgaactt

SEQ ID NO: 151 - DNA, 1330 bp, Rattus norvegicus
gggttagtttaacatgggttcctccagctccaccgctctggctcgccttggactccccgggcagccgcggtccacctggctcggcgtcgccgcgctgggactggccgcagtggcgctggggaccgtggcctggcgtcgcgcgcgtccccggcggcgccggcagctgcagcaagtgggcacggtgtcgaaggtttggatctacccgatcaagtcctgcaagggggtgtcggtgtgcgagactgagtgcaccgacatggggctgcgctgcggcaaagtgcgcgacaggttttggatggtggttaaggaagatggtcacatgatcactgcccgccaggagcctcgccttgtgctggtcaccatcaccttggagaacaattacctgatgctcgaagctccaggcatggagccgatagttctgcctatcaagctgccctcttcgaataagatccacgactgcaggttgtttggcctcgacattaaaggcagggattgtggcgatgaggtggcccggtggttcaccagctacctaaagacgcaagcctacaggttggttcagtttgataccaaaatgaaaggaaggacaacaaagaaactctacccgtcggagagctaccttcagaactatgaggtcgcctacccagactgcagccctatccacctgatttctgaagcctccttagtggatctcaacaccaggctgcagaagaaagtgaagatggagtatttcaggccgaacatcgtggtgtcaggctgcgaggctttcgaggaggacacctgggatgagctcttgattggtgacgtagagatgaagagggtgttgagctgccccaggtgcgtgttgactacagtggacccagacaccggcatcatagacaggaaagagccgctggagaccctgaagagctatcgcctgtgtgatccttctgtgaagagtttataccagtcgtctccactctttgggatgtatttctcagtggaaaaaattggaagcctgagagtgggtgaccctgtgtatcggatggtggattagtggatcccgtggactgactcggtttggattattcacaactgacagtctgagtaacagagtgatggggaatcttgtcatttactcggcttccctgggagacgacgcatctgcaagtcctcacggccatcttcctggaaatggatctctgttcttcctctggagctgcacatgcccgagttcattcaagaaagctaccagaggtggtttgggaatgtgacggtgtataaattttagataatgaggttttaaaaaattaaacggaattgttactcccacggttaaaaaaaaaaaaaaaaaaaa

SEQ ID NO: 152 - DNA, 508 bp, Rattus rattus
gccattaaaaaactttattttgatttttttttttttacaaaggatagccccactttggggtgaaaatatatttggttaagtacaaaatatagtttttaatcatacaaaaagatacacaaaatacaaaaacaacaaagacgacacctccatcagctcacactttctggctgcacagttctcgggtggagtgcttagagtggagcttggagctctgacacaggacacggaacaaagtgctaaggcggagtaagttttggagtgctagaggccacggcgagagcagaactttctcctaacactggacaggaaatgggtctgggagcttccatggaaacctgcagttctcactgtgcctccatcactgttagggcatctcaatgtaagagtgtcaccagggtccagctgtcagcagcaacccttcatatgagtagtgtcagaatcacagaagtctgtgtgttgggggaaagcctccaaaagtaataaccaagctgggcctttaacctcagca

SEQ ID NO: 153 - DNA, 474 bp, Rattus norvegicus
tttttttttttttttttctcatagagaattttaatctgaaacctttaacagcagagatttgggccttcatttgaagagtcttcaaaagcctcttacagctgtaacagttagggtttctattgccacaaaacaccatgagcaaaaagcaagttgggagggtgggggtgggttatttggcttacacttccatactactgttcattatcaaagaaagtcaggacgggaactcaactgaggttcccttttctctgatgaccctagcgtgtgtcaggttgtcacctaagaccagccagtacacatactttagagaaaaaaggttttattttggggagggtgttaagtcttgctatgtagcctgctttcttaggacccaggatgaccagcctaggggtggaaccagccacagtgggctgggccctctctcattgaccactaagcatccttacagcatttcctcaactgaggttccccctc

SEQ ID NO: 154 - DNA, 572 bp, Rattus rattus
aatggaaaaagccattaatattcaaacaaaggaatcacattttaaaaaccctatacatacgaaacagcttccaagaacattcaagcagcagtcaggagggaaaaatgtttcaatagcccaattttcttcaaaatatgccagagaatacaatccaattcactgctacaattcatagaattcttcagtgttttcttgagacgctgaggttcactgttggcagtttccagtggccggcgagtactgctcggaaaggccagcgcagacagctgaccggaagaacttcctgctggaaaactgctcattcccaaggaaagacatttgaaggccgggctgtggccctcacaactcgtccttctctaggtcatcgagctccacatcactgaggtcaatgtcgtcctccacaggaagctcgccatccttgccatcccagggctccctgggagtgatgttagggaaggaaccaccccctacgggtgctgtggagccacgcccgaaagacagttccctgagaaactcattgatgccttgttcactgaaagagcctttgagaagagcaaacttcatcttgcggg

SEQ ID NO: 155 - DNA, 539 bp, Rattus norvegicus
tttttttttttttttttaaatttacacttctttatttagtatgtgtgtgtgcaccatagcacacatgtggagttcagaggacagtttgaaggagtcacctccctccttccaccgtgtggatcttagggaattagccttggctgaagcacctctacccaggacgcctgcccaaggagcagggtcatcaactgcttggagtggtgcccagattgcaggctggctctgccgggacaccagctggtagaggccccaaactccagacagaacactgcagttccatgtgccctttgccccaaagctgccgagaaaggctgtggtcgaaagggcactgggaacggtgggcctccatgtcatcactgcttctccccacccccaaccctaagctaacacacttgtgctctgggtgtggggacagagaggcagggcccatagccaccccatgttttggagtcagagctctctgagccagggtcacggtgccaggttgcccttctttcctgtccacagttcacgaagctccacacggcagcccaggtctc

SEQ ID NO: 156 - DNA, 520 bp, Rattus rattus
cagaaaacaagtgttgcttttaatatcaattattggagcatgcaacattgctaaatacaaaagtcatagaagctcacagatgacttcccaggctgtcgctagtcaatgaaggaacagttccgggcctctaagacatcattatggatcctttcttggtttaatttaacgactatactttcccccttactacggcaggtctcattcagaagcttgctgcccaacagttacattttttcttattcctctgagaaggataaagatgtcatttttaaaatctacattggttccatgctgtcatgtgtgcggaagactcagtggtaggctatcgacgggctatgttagtattccctgaaaaatgaagatcgtgatttctgttacagggcagaaagcatttctgtgagctcaggatgaatatgtactgacataaaatattctcagttaaaaaaaaaagttaaactcaacaaattcaacagcttctcattcattgttaatgtgttaaaaatggaaaattctgtgtttc

SEQ ID NO: 157 - DNA, 480 bp, Rattus rattus
tttttttttttttttttttttttttggttttattattatttatttttagaaaagaagagaaggtgtatacgatgcaaagtctcatacagtatgctattgttggttgcctcctaacaccagccctgtcttgtgactcagtgatggagatgatggacagcagggatgtgctggagactgatcacagacacacaatacaccacagtaaacttgaggacagatgatgctgggctagcctgttccaaaagcaagccaacacatggtagaaagcaaggaaaccaatggacctctctctgtggggaaggcatgggtgtgaacccacaagcattcccccgtcccacacacccaccacaccctacttcatcagaccacagcaatacacaaaatggaatggtcctttggtgtttctcagcaaggatattcaggttcccagtgtcttgtttctgattttcttttcatatttgagtcccgaattcttaaagc

SEQ ID NO: 158 - DNA, 349 bp, Rattus rattus
  misc_feature (64)..(64): n is a, c, g, or t
atgttcagacttattttaataacaatacatacaccatcttggcactgtggatggaatgtaagtncaggttggacagggggattttacagtgcatttaatattctgtgtatccaaatttgtatgtaaatattggaaaaaccagcccgcccaccgttcacctctcaccttcggtactttaatagccatggccttatagacggtggccacgcggcctgcacaggctgtgtgcattaggccctttagccttgttttacacttgcagcacctacttctgctggggttcaactcagtgcacagcacttgcttagcctatgtgaggcccctgcacttaaatgcccagcaccacaaa

SEQ ID NO: 159 - DNA, 508 bp, Rattus rattus
gaagggaggtgttggcatttatttctggagcagggcctcagcactggacacaattatgcatgaagtcaacacacagacttgtatagtaagtaggatagtctcggaggtggctgacatgcgcagatgtcacgaagtccactccgcgcactgagacctggtgagccaggcgttcctccaccatccgttccacatccctggctgagaccaccttatcagctctagagtagaggtagagctcgggccagcaggagcctgaatcctgcagcctgtcgtagaagtgggtgtggaagagggccgtgaatggagcaaacaggaagtggaacaggaccaccaccagcgcaaatgctgccaggagcaacaggcgaagcacggcaggtctgcgctccaggatggttgccagggccctcagggcccctatcaggtcgctatccccagggccactgtcaaagatggtgcccaccacatgcaaatggcggaagcgctgatgggtctgaatgagctccagcac

SEQ ID NO: 160 - DNA, 516 bp, Rattus norvegicus
ttatgataggcacaaatctttaattcatctagcctctaaagtactctaaagtactctaaagtaaatcggactatccacaccgtgggcattcagcttctcaagttagttaacaattagcctaaagaaatcctggtacttgaagctggaggatgtgagcctggacaggaatgctgctatctctggatgctgtgaggagacacattcttcttcagagacagagcggagcccgtggaaggcttaagcaagtttgtgaaagacgatgtacctgtgaacatctttctttccacttcttcttgaattttcagaagaattcgctcttgttccaaggcttctatgtactttgaatagcaccaagtgggctgtcggccataggactgcaggactagcaaggactcgctgcctaaagtaggttttggtaagagagcctgtagtacttgcatactgcttgactccagactttgcagctttggcctcttctatgtctgatgttttccttttctgcttatattcttgcct

SEQ ID NO: 161 - DNA, 563 bp, Rattus norvegicus
tttttttttttttttttagaagaagcaaaaatatatttcagaaattctaaacaacagacaaacaatcaagccccccaaagactgaagaggtgtcatggaaacactcaagaagacccataccatacattttcttctgtggttcttctaagagcagaaaagactagaaagattgagagtttttttttccccaacagagggagcttcaatcaagaaaaagtaaaataaattcttattgctaagatatgaataaagttaaaaaaatgataaatcagtttccctgggtaattcctgggcatttgtaagcaagtaaggctaaccagggcccatcaccgcttctaattaaaacatagagagtccctggctgtttgaaactgtcctgtcaggggcaggattcctcgctgggagcttttcccactcagggccaaaccccttctcccaaatgtcctcagtggacaggcttcaccgcttaagcccattctccatggacatttgggagagggtatggaggaaagaaagagagggggcaatgattccatactggctgagactagaaactgtcctta

SEQ ID NO: 162 - DNA, 295 bp, Rattus norvegicus
ttggcttaacacttttttattggttcatttgggtttatccatggttcccctcatttaaaaaaaaaaatcagtggttctaatttcttggattttcaaccttaagttccacgttgacaaatctatttttatgtacacctttgattcttacattacaacagaagtcacatgtttaaaaatacccactccttaaaacataggcattgtcaatattttgtttacaggacacatcctgaagacacacacttgactatattaagatatattagcctgaaaacacaatgtgtgatattattgt

SEQ ID NO: 163 - DNA, 469 bp, Rattus norvegicus
tttttttttttttttttaaattaatctgtgcaatacctcatttaatctgtaaaggtttgttataatcctatataaagctactccctgttgctgtgtgcaagtttacaacaggatgctcacgtgatttgtgaatattttcattctatcaacaagggagtttaattatgtgtgagactgacacaaaccttaatgtaatttagttagaatgccagaaggagaacactattttcataccctactttttctgtacctaaattttcttaataaaatttagtatagcactacattctttttcaagtgatggaaatttagtttctttagccccttcattttgaatatgatgccacatatgaatgttgaagctgatacattgcacaataccctagacaccactacactgatacagtttttcaaattctagtattatgtgttgcttaacatcactacagagatgctgctgaagagagac

SEQ ID NO: 164 - DNA, 254 bp, Rattus norvegicus
ttttttttttttgttttcagtagtttatgcatactttgtcacaaatgtccggggatagggtactggactcctccaggcaacatacaaaataggtccaagggacagggtgggctggatttgtgataagtagagactgggttggtaagagagcctggggaggggaacacggcatactaaggatggggctgcccccatgttgagcctgctcattcctggtgcaggtgcccccccacctgcaaggggatcttcaaggt

SEQ ID NO: 165 - DNA, 350 bp, Rattus rattus
aaagtcagagctggctgagcttcaggggtacagcaacagctcaaggaagggtgaagctgtctgttggtccccaccaccgcgagttggggagggggtttcatgccaacagctgaggctcctcgcagctcccgggcgatgctcaagcagggagagggtggtcacggggagagggaagctcctgacgctccgacactgctggcttcttctccccactcctgtcccttttcagcacagcctggctacccagctggcctggggcagagcaaaggcccacgaccagtggagggacgtggatggggacagagcaccaagggaaggggccctcggcccaagggaggagggaaatggcc

SEQ ID NO: 166 - DNA, 743 bp, Rattus rattus
  misc_feature (553)..(553): n is a, c, g, or t
  misc_feature (559)..(559): n is a, c, g, or t
  misc_feature (569)..(569): n is a, c, g, or t
  misc_feature (616)..(616): n is a, c, g, or t
  misc_feature (638)..(639): n is a, c, g, or t
  misc_feature (647)..(647): n is a, c, g, or t
  misc_feature (649)..(649): n is a, c, g, or t
  misc_feature (655)..(655): n is a, c, g, or t
  misc_feature (659)..(659): n is a, c, g, or t
  misc_feature (696)..(696): n is a, c, g, or t
  misc_feature (728)..(729): n is a, c, g, or t
aatgatgaattaggcaaaaattttatttccaagctcttcaaagataatcacaaacacaaactttccttctaaaagtgtccccaattaaatcaaaggcacatcacccccaataaaatatgtgtgacatgaattcttttaggttataatatcttcatattttgtttttaaccaattgcaacgttctaagtgtagatcacatttaaacatttttaaaggcatgagcacacttttcaaagcatcagacacaattataagttgtagagtacaggaactaaagaaagttctaatggcttcacacgggagggccacctaacaacacatccatgctccgtgtgctaaggagcggctccccagcttcccgtccaggtcagaccgtttgctcactgggactggaaaggcctcctttacgaaaccagcatatcaatcattccccaatttatactttgtctaatttagtaactgtaaatttttatgaaaattttttattacagtataaaaatgttaggaaaattacagatactcagttttcggaaatacaacatttcatccaganatgcanataccagtanacaaaacatgcctccatcccaagcagggccgcacaggcttgactganagatgcacccagtgagtttggnnatgaggtnanaaatanacanacatgatttcgtaaaattttgactagacaggcacaanaaatgattgttctgaatcgttttctggactgnngtatcatcacacca

SEQ ID NO: 167 - DNA, 499 bp, Rattus rattus
agctgatgcagccttggtgaaagctgctgtcagtatagagcatggtaatagcacgtatacagcatggttatagcatgtgtatagcatgtatatagcatgtatacagcatggggtcaacggcgtgaaacaaactgtttcattgcaggagaaaagagcgattccagaaacactttccaacttactttgccactgttaatcactctgagtgtttgcagccatactggagagccagcttattgagactgtcttcctgggccagctcccgctgcagcagcaccatggtgcccgttcctggcggttggctgctgttcttctggcgttccttgccccggggtcgtaacaccacctgatgtgactcttcctcggaggagtccccggagtccccgctgccattcttgaacatgtaaacatgactgtttggagtcctacagacaacagctgggccttggaaggtcttggctaacacttccttctgcctcatttcctttcttaacttttc

SEQ ID NO: 168 - DNA, 537 bp, Rattus norvegicus
ttcaaagtctcttctcttagtgctttattataaattagcagcagatgatacagatcataatgtaccgagcacacacgaacccggcagccctgatgacgcagctcagcacttgctgatctgcccggcttcctgggagcattgcccactccggagggaacctctatgtaggacagcacactttcgttcatccctgagtgttgtcatagacacacagaactgcaatggccctccctctccctgcaggggtcagtgggagtctctcaatcattctgtgtgctttggccccacggtgactgtcctctgtggctgtgatgacagttggtcgcttgccactctgagggtgtcagctgtctcttcttcatttaagtcttcttgccatgggtggggatggccaacttgtgtgacctttggccacaggccacctctgtaagttcctctgccattttgctggttcatttatttttgttttactggaaattcaaagtttgaatcctttgtcagttatagactctttgtgaaggtaactgccaccggcgg

SEQ ID NO: 169 - DNA, 512 bp, Rattus rattus
  misc_feature (496)..(496): n is a, c, g, or t
ggccaagaatcacacatatctgaacgtgctggtggtaccctttggaaaaactcccatttgggccttttaaaactgataatggccaggtggaaccttctgtaacccacttgtttcaccagagccttagtaagtacatgcctgatactgaaaccaaaaccatgcgcactttggtgcctttgtagtagtggaaagtaactgaacctctttcttttcaaacctagatggatcggcaagccgcttaacagaggactttgggggaaaggaccacaaactcagtccatcggtccgtggaagagtccttggaacaagcaactggctattaaaaaggttattttgtaacatttgtctaactttttacttgttttaatctgcctcaagtggcaaacttcattttatgtgccattttgttgctgttattcaaatttcttgtaatttagtgaggtgagcgacttcagatttcattattggattggatattgaggtaaaatttcatttntgtttatagtgctgac

SEQ ID NO: 170 - DNA, 529 bp, Rattus norvegicus
tttttttttttttttttggcattttattggtttttattcatgaagtagagcttttacttcatcccagcgttttcctcagaggtagactttgatttgatttcaatgagttcttcgactcgagccaggacactttcaatcaagtcgaatgtgaagagggcggaatgtaagaccttaagctgcatctcaggaggcatagtggggatttcttctccgcctacagtcacagaacaaacacttttacacattgaggcagcttggctattttgttggctgtttttaatctctgcttcataatgtgcctttgacatattaagtcctacatgaagtggctgtagaaagttattttcaatctttccaagctctgtccataatccagtttggttgtcatcttcattatctttgataaccaaatacctcaacaaatttagtgaagccataatccggtctgagttctgcagtaaatctgtctcagcgccctcagggagggacaggaccaggtctaacagagaggtcagctgtgcgcctgcaa

SEQ ID NO: 171 - DNA, 466 bp, Rattus norvegicus
  misc_feature (455)..(455): n is a, c, g, or t
cggccgcaaaggtttttttaatttttttttaattttttcaatttttatttaaagctgtactccaaaccaaatccttcaaatcaaaaagctgtttcaaacaaatttgtacaaatatcatgataccagtgttttaaagataacctacagacaattataaaaaagcaactattatacaaaagaattctatggtaaactgtttttataaaaccttttagaaataaacttgtttcatgatagaagataaaaattaaattaaccctaaatacattaattgctctgaagatgggctgagtgttttgaagtcacattgcttctttgagaaagggcgtttgaaccaggcactacagtaacagatgcacaccgtaccctctcactcgagccctctcatctctgggtttgaaaccctttttccagaaatggataagcaaaacctaccaaacaggagtgctgggtcncttaacttttg

SEQ ID NO: 172 - DNA, 455 bp, Rattus norvegicus
tttttttttgcttttttttttagaaaacatggtagctcttattttatggtcaaactgtaaataaaccttaatccaaagcacccatcatttggagccgagcattcttggtctgtactcatgtatctcgcaaagagtgcatcaggaatcaggtgtccatgtgatgcatgggtcacttttgtcaccttgaatagcaaactattatgctggtataatactctccttattaatttggttggattagaatattcagcatttcttactaactctgtgaattgcaattctgcaagtgaacggtcagagctcaagttcccagcatccctttgcactgaccacattgctgctgtacgtagtctcaggccacttggctagtcagggtgagtagacacgggactgctacacattcctgtccccgtgcagtcataaacctcaggttgaaacaaagtctaagctgggtc

SEQ ID NO: 173 - DNA, 499 bp, Rattus rattus
aaagggcaaaacactcagacaatttaaatacaagtcgaacagaaccgctgtcagttggccacgatgccatcatgtgtcctctggagtcctcacagtgaggaagaaggctctggcaatgacaagagaagtgggtttcttggtgtgcagtcactgattctaagtgccatcttcaaggtgcccaatgctctgaaactaagtatctcaagcactaaaacacaagagctgaaccagcaatgattgtcagctaaagcttaacagtgggcagcactgaccatctgtgagccaatttgaccttcacagagtcatgatagggccaacgtcattcccactttatgtgggctcagattcaacagctcatcaaagatgaccaggctcacagcatacctgacaatgaagccaacttgggcctgtctctaaagcccatcctcttagttgtgagcaatcctgggtcacctgagcaggtgaggcttacgctgggtgggtgcctacgactgaggtt

SEQ ID NO: 174 - DNA, 367 bp, Rattus rattus
acagtgacaagaaggcttacaaaggagaaggaagaagaacacattggacacctgagattgacaagggtcatttttggtccaagtgctgttaacatttttgagggagttttaaggcatttgggtctcagggtttgttagcttgccctattgccttcttagccagcagttctgagcaactctcaagctttgttaccatctgaggtgcatcttctttctgtgtacttctatttctaactcattgttatgctgttactctctggtctcccatgtagagtactcaggaggattttcttgatctttccgctccattgagaacatctttaattgtatgaaacatcgcaggttgtctttatctacagagtaaagg

SEQ ID NO: 175 - DNA, 216 bp, Rattus rattus
agagatccagtttgacgttttattaggtccagccctctgctacctgagcagtttcctcatcatccccagggatgggcttctatactcccgcccaaagtggttccaatggtttaggtagttaaagagctggtagagcagcaggcgtttgtcgaaccctggagcctttgggatcttctgatggtaggcagtgaagaatgatctggggaaccccccaag

SEQ ID NO: 176 - DNA, 641 bp, Rattus rattus
gataaaaggcaggtaggaatttaatgacgaatagcccatattggttgctgaacaccaggatgctgtccaaggaaccatccttaaataaaacaacctgaaaacagagttctcacacacacgagcacactcacggactctggaactcttgggatcattaaaccactactttaacgaacagatgtaaaatcacactaaaatgggaagtgggcacaaacttcaggaatagtgcagattgtctatgaacatcattttcttttataattttccatttacttttcacatatatgtacagtctctagactgtaaaagagaccgagtggctcaaaggacgaactacccacctccttctgtctcagaactaagtcatttaagctcataaacgtcttcaagtttcacttactaaagacagcaaatgaagccggcttttgaccaagttccccaggaaataaatagtacatagacctccaacccagcaacccgctggatcaaggaatctttaacctttcgagcatgaaccacagtcacaagcgtatcctgaaaaaacgctattcttctaagactgaagacagggaacggccacctgggcgatggaatttcatgtgatgcaggcacattccctgaagaggagaaacagagtcaca

SEQ ID NO: 177 - DNA, 417 bp, Rattus norvegicus
  misc_feature (405)..(405): n is a, c, g, or t
tttttttttttttttttgagctttattacggattttattaaggtgaaacctctaggaacaaggagtcccattcagagggcacgagagcccacggagcctcctcagatctcatagtgaaccacgggctcaggttctttggaaggatcaccgcctcgctccaggtacagattattgtacgggtactgcttcggacccacaggctggtaggaagggaacatgtcccctacccagaacatgaaaaccatgaaagccacaaagccgaagagatgtctacacatgacatcccaggaaaccggtgtaggagatgtgtccacacgattcctgatgtacatgtctaggtcccagtgtatcggttcaccccagttcagcctgaggtctgggtggtcccattcataccacggatcnctctcatgctgt

SEQ ID NO: 178 - DNA, 606 bp, Rattus rattus
aaatggaaggtacacatttattaccagagaagagaaaacacacacaaagcctggatcctttctcctcatgcactagttttctatgcagtccaaaaccaactgggaagctatttacaaggacaaacttcctaacatggtcctggactgtggggtgggctgcttcttatagaagccatatactgcaaactaaatatattcttaagagtttacaagaagctttagagcaactgtatcaacagagaagactttttagtgcaaaatattataaaagtgatacaactgtgtgcctcttaagtgtttaattatctgatttgaacaaggaaatgagcaaaaaataagtggtggagaccggcctggctttatgactttttatactcaattcgttctacttttacgtcatctccaattagctgatagacgtaagtgaccacggtagaagcctggatgtccatcagcacaaatgacggaataatatttgtttccaaggcattataggctccagtggcagaacctgggttaatatagaatttattttcatgctcaaatgcttcgaatttgtgtgtgtgtcctgagataagaatgtccacatcaaactgcctctgcagc

SEQ ID NO: 179 - DNA, 396 bp, Rattus rattus
  misc_feature (28)..(28): n is a, c, g, or t
  misc_feature (87)..(87): n is a, c, g, or t
  misc_feature (246)..(246): n is a, c, g, or t
  misc_feature (316)..(316): n is a, c, g, or t
aaaggtttggcactttattaaataagcnccaaaattacatacaaatcaaaagagtaagaaaaataaacactcagcaaaatgtctctnggtagcatccagcaccactgcagttaaagtatggcatagctgtggtatcaccatgctcgctctccccgtccccaaggatggcaggacagggacatcagctttccaaaccaaactgtcatcattcattgctatccctttctttaccatttaacatacagngaacacacttcaatggaatagactaataagccaagagctttattgatgcagcaggcactttacaatggancccaagagagcctgccttctctgagaagacaggatgtctgtacaaactctcatcaggttttttccacttcagaacccaag

SEQ ID NO: 180 - DNA, 495 bp, Rattus norvegicus
tttttttttaattttttacgttttagaaaaatttattttatatacaacttatttgaaaattttcagtatgaacaatttcaacagagtcctttagatgcaatttcttttgggttcactgcaacactttttgtaatattatatgttttatagatgccaataagtctatctgaaatctcaaacatattatttcgaagagagattattatgaactgtgcattttttgtttgctcgtatatatagaatgcaacaatagacacgtttttaaaatccagagcggcatcaatctcatccatgaagtacaggggagtgggtttgtagtggtgaagggcaaacaccaaggccaatgagctaagggttttctcgcctcctgaaaggttaaagatcttcttccaacttttcttaggtggtcgaacactgaacatgattccttcagaaaaaggatctaaactatccacaagctccagttcagcatcccctcccaaagtgagcatttgc

SEQ ID NO: 181 - DNA, 550 bp, Rattus rattus
ttttttttaacacttacaagcaattttattgagacagagccatacctgctggtttatacacataattgtaacaggttacatccttctcaaccttctgagtgctacaaccttttagtgccattcatgaccccaaacataaatttattcttttgctactttggaactgtgattttgctactgttctgaaccgtaagtaaaaatatctgtgttttccagtggacccacagattgaggactactgggctagaaggtcctcttagaatctaaacattggccagataccactcttggtgaaaatgcagacagaaacactttataatgagattcactgtaattcgtaactttattaaggaaccgatgtcagcactgctatgtaaacaatgacaaagatcaagggaaacacatcagggattatgtagacagtaatatacattgtcctttatataatcaatgtataatagttaaggaaactttaatccttattaagcaaacatttttgcatacactgccttctctttatctttctgtgcctttatcatttgtttgactt

SEQ ID NO: 182 - DNA, 370 bp, Rattus rattus
caagtcaagtttttttattttattgtcagttacatgctttatagaaaaaagtgtggagaaccggtcagggttgtacaaaaaaaggctaggttcctacgttgttttatttacaccattgtgaggacgcccccacttcaggcgcagcagctgcacttgtccgaagcctctttgcagatgcagccctgggagcacttcgcacagcccacggggcagcaggaacagcagcttttcttgcaggaggtgcatttgcattgtttgcatttgcaggagccagcgcaggagcaggatccatctgtggcacaggagcagttggggtccatggcgaatggaggcggcagttggagatcaacgagagatcgctcctcgtgcc

SEQ ID NO: 183 - DNA, 341 bp, Rattus rattus
  misc_feature (118)..(118): n is a, c, g, or t
  misc_feature (236)..(236): n is a, c, g, or t
agaatgaatgccttttaatattatacacatgattatgaacaggtaatctcaagtattcaatcactttcttattggtagacgtgatacgtgatttggtaattatagttacttatgtttncttactacgaagtgttcttttcagtcaagcagcaagcatttccaaagctagttagcagatgagtaccaacaatggcactgtacccagtaaactcaagactcttagtaaaatgatttcnctagtgttaaggaagtagtcattttttttaaaaaaatattagaacgttatgaaagtttactctcgttaagttaatgattttattcattgtgtccattcttcatgg

SEQ ID NO: 184 - DNA, 472 bp, Rattus norvegicus
tttttttttttttttttccatttggctctttttattagagaaatcgagaagacagcgagtagggaaatccccatagtgaatggaaccatcacatagatgcctttctggaaccccaaccttctatgatccccaaaagtgtgcttgtgatttcagcaacttacaaaggggagaggaaatactgagaaaggccactatttaataatgaaggagtgaaggtgtctctaaactgggctccaaatctccgtggtggttgtcattgttacctccccttgtatcatcaagttggtgcccttttctgagccttatatctggctctggagtcctggtgcaccccaatcggtgttcggttggctcgttcatgggataccaaagccttccttacaaagtggtctttctttctgtcccttcttcttgggagaatggatttctaagggatggtgagttgaccctccttccgacccaggcaatctgt

SEQ ID NO: 185 - DNA, 518 bp, Rattus rattus
gaagagctttttagtagctaaatatggcaccacgtgactcagggcaatataaattacagtatgcaaaacacactgactggctgaggtaaagcgcaccgttcctgcctcgtgtccactgtgagggaaattgctcacatgctttaaaaaacatctccatcatatatatatatatgtaaaaaaataatcccctagaaaggccaccagagaggggggctacaacgcccaccctctaccatgtacggagcacccactggagctgggtagtgtagtgtccacccctactgcttgcccagagctctgtgtccaggcaaagatgctggcaatagggttggtactggtgggccggcccttctggtgttctcggtagtggcgggtgactgtcccgtgagcagcctcagcttcaatggtcttcccgtcagggcagaccagcacagatgtcatcaggccaagggagccaaatccttgagccaggatgtcagactgtacatctccgtcatagttcttgcaggcccacacaa

SEQ ID NO: 186 - DNA, 556 bp, Rattus rattus
gagattatagtaaaagagaatttattctatacactgtctgcctccgtgattttaatatgagaaacgtagtgcttatcaaaaattggttagatacttttttttttttaatatactacacactggattctaacccaatgaatgctggcttcagttttcatctccaatctctttcttgatccagtcaacataattcagtaacttggtgtaaaagccgtatccctcaccacacccaatgccccaggatacgatgcctgtagccacccagatatcacgactgcggtccctgactgcaaaaacacccccactgtccccctggcaggcgtcatgcttgagagttgggtccccagaacagaacatattttgagaaaatacatcattactgtttttcgtccggagccacctctggcatgcctctcgatcggctatgggcagacggacaaacctgagattaaaagctattttatcttctgttatcccgaagccgctgacataacccataaggtctttgtcataaaaggtctcattgtctgggagacagatggggaggaggttggga

SEQ ID NO: 187 - DNA, 553 bp, Rattus rattus
cacaactttaatagaatattctaactattctgtacaaattgaaaacaccgtattcagttacaaatgtgttattgggtaaggctgagcacgctctacatggctggtcactgtggacatggctgtcctggctaccagagacacaaccacacactcggaaacaccccccccccccacactaaccaccaactggtcaccaatcccaggtgtggccctggtgtgcacagtacaagctgaagctgtgctctacaggccagagatcctactgagggagaacttcctcgtagaacttagcttctatgtgcgcacacctcacctggagctgcttcagagcattaattcttcttttgacagctttaggtaaagtttctatgtaactagatggagtgtgagagacgttgtcaagacgttcctgcaaagctgccagcacttgtgggttctgcatcacctggtctgtgagtttttctgtattactggcatttttagcagcttccacagaatctgctgggcctccatctgaaagactgtttttctgcatctgaacacctttgcctcg

SEQ ID NO: 188 - DNA, 337 bp, Rattus norvegicus
tttttttttttttttttgaaaattcacaattatttatttaggtaggggccaaaaaaaacttttaaaaaatacaaaagaaaacccacatttaaatgagtaagaaatataagggcaagtgaaaaaatttagggttaaaaaatgaaaccatcaaaaactgacagtcagaggacaaccacagactatttaaaaacggcagccatgcattgtaaaatttttaaattgcaaaaaggcattgggctttaaagggaatgcatagctttaaaaattttccagtgatcccaaaacagatttgtaaagtggtctaaattaacatgaaaggaaaacgagacaagaaccc

SEQ ID NO: 189 - DNA, 557 bp, Rattus norvegicus
ttacattgtctgcttttattccttccagccacagagcccaaaggagcagcctttccctggtagggcaaggaggcaaggatggagttgcccacgcccaggggacctgcagtctggatgaacacgaagaccagctccttactgaacgccctccatcatcttcagaaactcgtcgaagtcaatgcggccatcgttgttcttatcaccatccttcatcagggattcgatctcctcgtctgtcacatgctccccagaagcccggaaaatctcagccagctcctcggcatcaatgtaaccgactgcgttcctgtcaaagatgcggaaacactcagccagttcctcttcgctcttccctttcgcatcctctttcatctggcgcaccatcatgaccaagaactcttcaaagtcgatggtaccgctgccatcctcgtccacctcctcgatgatggcgtccagatcctctttggtgggtgtctgccctagcatcctcatcacggtacccagctctttaacgctgatgtccccaccaccatcagcatcaaacccggacccgtacctgc

SEQ ID NO: 190 - DNA, 507 bp, Rattus norvegicus
tttttttttttttttttagaaaatatggtttttaatattttctcctttttgcatttataacataattcacttagacaatcacagaatccttttcttccaataccacaaactgtattacaaatgaaatctggtactgctgtttatcaaaatatacaagacaatcgctgttttatataaaaccactttatatgttaacttgttcccgaaaacctttttttttcttttttggcctggttttaaaaaaagttgttacaaatatttacagcattttcttctgttagatgaacattcttacaaacagaaaaagggaattttatgaacagaccatgtaaaacactagacaatgttagaggcttctagctgtgctatttgcccccctcaaatacagtactgaaaataactatccatcgttgctgtcccactctgttcatagtaaactcccattttctctaagcagtctattcaccaatagaaaatgaaaagtcaaggccgctctgcatgttatct

SEQ ID NO: 191 - DNA, 416 bp, Rattus rattus
accttttccacaacattttattttaaataaaatttcaagtacttttacataggtacaaaagaactctgatctatgtgcctccaacaggccacaccacacagtagataaaacacagtggttacaaatgtcttgtaaatttatttctgaggcaaggcagatgggagggaagtgtctctatgaaaaaatactgtgtgtgtaggaaatcgtcacgattttatttcacatggatacaaatgattatactttaatttaggccctggtggcttaaaattatataacaaaatagaaaaatggaaaactgctatcccctacaccctgtttcaaaggcaggcactaccaagattcgggagacgccacagtgtcggtggaggataattactgtacaggttgtaattaccttcagactcagataaaat

SEQ ID NO: 192 - DNA, 530 bp, Rattus rattus
gttattaaaaggaatttaataatcttaattaaaaatccataacagcgaattccgtcacaggcctcggcagctgggagtaactccagaggtacaggccccttggtgatacggtcagaccccaccttggaggcacgaagctacttcaatacaatatcaaagatccatgagaatattttttttaaaaaagttttaaatatattagactcttttgattgccatttttacagaaagctgctgatacagtatacagagtttttaacttttttttcacataaaatacattttttttcttaagtgttctctgtacatcagtggcttctggtctggtgaattattgcggagggctgggtgtctgcagacttttccagggtgtgcagagccaggccccgcacagtggcattagaagtgcccatgagaaggaggccctctggctaacaagggagaggccttgggctttctagaaaaagagtgggtcacttcagtggagctgtccaccctggccatttgatccttggcttttctgtgccctg

SEQ ID NO: 193 - DNA, 427 bp, Rattus rattus
actgggactttccccatcagtgcaaatcgtttattgtgttggtttccatggtggctggggtcatgggacggctttggctacagagctagagatctggtctgggcaaagctgctctgcagcccttgggcttcaggagcaacaaggcacaaggtgagaccttcatcaggtaagcaccacagagtagggaggggatgtgcctgctgtgccagggtgcagggagtggaaaagccttcgtcagcacaggacctggtggaattgttactgctgttggtgtttttataaagaaagagaacgtcctgaacctcgtccctgtctacgtctcccagagccagaaagtcgtacgtgactgcatagtcgtagtccagcctccacttgtcctcagaggacggtcggtctgggcatgggatgatgaaagagaggacaaaca

SEQ ID NO: 194 - DNA, 547 bp, Rattus rattus
gacacagacacaaaggcagctgtggtaatggggtgggggacacaaaagcaaaaatcacacttcctacatggaggcctcaattagacaagagagaggctgggtccctcccctcacactccttctgacagtggctggagtaacagctctctctaatccaagctcagaagcagcaggtgacccccacctagcctcaaaggtccccactttggctccagaagcccctgtccttttaaccagcccagtaattcccctacccgagctccttctcccccaccagtgtaaacagagtttggggctgaacaacagagctctgggaaggcaggagcctcctagatagcaaagggaatgtgcttggagtttcacttcggtcccagaatgagacccagcagtgtctcccagaactcgggctgatccagtatactgcctcttcattctccaccactgacagagataggccaggccccagaccacagtaaaaacaattgatccccagaggttagagctactccctacccccgacccctggcacatacacagatttttggca

SEQ ID NO: 195 - DNA, 515 bp, Rattus rattus
cgggtgaaaatcatggcaaactttattggcataaatcacaggagttgaaatgggaaaagccaggttagaggtttaaggtaaggaaaaaaaaaatcaaatgatcatatatccatgacccagagaatggccctccaggtaccccagtctcttcttggaggggcctggagcaggtaggtcactgtaaacagagcagtaaggcctgtgggtggaagtgtcggtcggtgtcgtctgcagcgcccaagctgaccttgagctgggctgctgctagcccagtcctgactgaggacccttgtctgggaccccatcacactgggcctctgctaggaagctgatgtactgtgtaggtccccagcctatggaaccttccagagtgccttttccaggacacatgaggttcaaaattccaggtccaaagggctgaacattcttggaccagttcttaatgaaaagtgttggcctgggcagtaagggaagggtttgagaatacagcagtttaaaaaacagtcctgggagct

SEQ ID NO: 196 - DNA, 528 bp, Rattus norvegicus
ttggcaaaggtaactgaagtttctggcttctgtgacgtggtttggttgttactcagctctcactatttaggtggtcttagtcccaaggtggtcactgtgctgaagtggcagagatggccagcccccgtctcgctgcgacatcagaccgtcgctgtggaaggctcagggctgctccatccaacccctcgatcacttacttcctcctacccaagtacccatctcttaccctcacccagtaaggcccattagcatgtttccccttcctctggcgaatttgcataattattcactgcctttttcctagaaccaaatcacggtaatgattttcctcaagtaagcgtcccacaactctcttgattctatcgtacacactaagtttgccctcgaattattgcgtcatgttaaacacatacagacaaagggaaggacacactcttcagtagagaatcagaggggtcggggctgagtgtagacaaggcagtatagagctcagccacccaagcccctaccagagcatgaagatagttg

SEQ ID NO: 197 - DNA, 2092 bp, Rattus norvegicus
gccaccggcacgctggcgaggccaccggccctggagcaccagtccgccgctgggcgtcgatgatctacaggccagggtagctctactggggcccaggcaagctctctcagacgccaggagggccagcacgagccagactgggaagctgcgagcccgagagctactgcggagcgccaaacaccccctaaacctgctgcgctcccgggcgcccggctgggtaaaggacagcttctgggagctagagaacacagagaagcgagtgctcgtggaaaagcaagatgtcacgatagacccttggccccagagtccactgaggtgagaggaagatctctgggctgcttggttctaggcggactgaagagcagccatggagttgacctctgagcagttcaatgggagccaagtgtggataccttctccctttgacctcaacggctcactggggccaagcaatggctccaaccagacagagccatactacgacatgacaagcaacgcggtcctcacgttcatctacttcgtggtgtgcgtggtggggctgtgcggcaacacgctcgtcatctacgtcatcctccgctacgccaagatgaaaaccatcaccaacatttacatcctcaacctggccatcgcagatgaactcttcatgctggggctgcccttcttggccatgcaggtggcgctggtccactggccttttggcaaggccatctgccgggtggtcatgactgtggacggtatcaaccagttcaccagtatcttctgcttgacggtcatgagcatcgaccgttacctggccgtggtccaccccattaagtcagccaaatggaggcgaccccggacagccaagatgatcaacgtggctgtgtggggtgtgtccctgcttgtcattttgcccatcatgatatacgctggcctccggagcaaccagtggggtaggagcagctgcaccatcaactggccgggcgaatccggggcatggtacacgggtttcattatctatgccttcatcctggggttcctggtacccctaaccatcatctgtctctgctacctgttcatcatcatcaaggtgaagtcctctgggatccgagtggggtcgtccaagaggaaaaagtcagagaaaaaggtgacccgaatggtatccatcgtggtggctgtcttcatcttctgctggctccccttctatatcttcaatgtctcgtccgtgtctgtggccatcagccccacccctgccctgaaaggcatgtttgactttgtggttatcctcacctacgccaacagctgcgccaaccccatcctgtacgccttcttgtccgacaacttcaagaagagcttccagaatgttctttgcttggtcaaggtgagtggtgcggaggatggggagcggagcgacagtaagcaggacaaatcccggctgaatgagaccacggagacccagaggaccctcctcaatggagacctccaaaccagtatctgaaacaacccgggaacgcaacgtgcacacgcactagccaagccccgcctcctggcagtgcgagccccattcacccgcttcctgcctcccctacccatcacacccggcttttctagagcagagcggatttgagtctggcttgtccgaaagtatacccctctggtcacatctacccctaaagtgaacgttttcgtgcaggcagacaattcaaagactggagaagaggacacgatggcctgggtgtgacccggtggaaagcagctacccggcagaaaccggaaaaaccaaaactaaaatcaaagttccgcgcgtgtacgtgtgcttgcccgctatgtaatctcgtgatctgatatttccgtttgtacatcacctccccacccccaccccggtctctgcggagccagtatacacgtgtcctgtgtttgtaaacccaagtagctagttcatgtgcgtctagtataggtggacatttaccacagcgctgaacctgacgacaaggactcaccatgtcagagtcaatctaatctaagcttccagcatccctcttgcatgggcctttcccagacccaggaggagcatgagcagtatgttcatataataatacatttttgtaaaaag

SEQ ID NO: 198 - DNA, 491 bp, Rattus rattus
gtagtttaaaggtcacatttattaggagattaaggggtgcattatccatggactataaatagtgcacagctgacacttcagtcacagtcaagcagaaatgtagccagctccaacctattttgtagacactcttgttcttttgttccaagaaaagtttgcaccgtaagacttggacttgggtttcggaaccttcctcccttccacgtcatagctccatcctagatgcaaaacaaaccaaaacaagccagaggaacagaattaatgagaatttttaagaaacacagcaaataagcagagttaacttgtataatttcatgttcatttatcaacaggcataaatgtcaacacatctgaaatatataaatttagtaatttgttttctctcaatcctgtgtgcaaacgtccatacactgtctaaagatgagttgttatttttcaaagtgaaggagtaacctatgatttaatttctacttaaaatgtattgcttagtt

SEQ ID NO: 199 - DNA, 640 bp, Rattus rattus
aaacaaaagcgagaatttattaggcaaacagacttgcagagattccaaaagctgtaatgggtcaatagctagagccacattttcctataggacagaacatgctgtagtcaccaattctagttctgggctctgtaccatcctgagggtggtcctgcttgtaccctgcacgagggactagagcgtgggttcgtttttgcttgcctttttatctttatagtcctttacgctggcctcaaacttgacaagcacatgctggcagacattcaagagctcattcaggcctttctgaaacggctcaacagctggaagtgcaccccgtgtctgaattcgcaaattaattttgctctctgaaggatgggtcgtagtgtaaccacaaaattccacttccgggttcttcatgattatgtaccgcagacaatttcctagtgtatggtcctcctcgtgtagtacaaatgtcacacactgtctatctgttccagctgcctggaccatttccagggctgtcttcctctcgccttcagccattgaggtcttcaatcctgatatttttctctccagctcctgatcgtcctccatcgcggggggcggctccgggaaatcctcaggtggcgctggcgaaaaggaagctcttccccatgtc

SEQ ID NO: 200 - DNA, 2116 bp, Rattus rattus
cgcaactgagaagactggatagagccggcggagccgcgaacgagcagtgaccgcgctcccacccagctctgctctgcagctcccaccagtgtctacccctggacccctcgccgagctttgcccaaaccacgaccatgatgttctcgggtttcaacgcggactacgaggcgtcatcctcccgctgcagtagcgcctccccggccggggacagcctttcctactaccattccccagccgactccttctccagcatgggctcccctgtcaacacacaggacttttgcgcagatctgtccgtctctagtgccaactttatccccacggtgacagccatctccaccagcccagacctgcagtggctggtgcagcccactctggtctcctccgtggccccatcgcagaccagagcgccccatccttacggactccccaccccgtcgaccggggcttacgccagagcgggagtggtgaagaccatgtcaggcggcagagcgcagagcatcggcagaaggggcaaagtagagcagctatctcctgaagaggaagagaaacggagaatccgaagggaaaggaataagatggctgcagccaagtgccggaatcggaggagggagctgacagatacgctccaagcggagacagatcaacttgaagacgagaagtctgcgttgcagaccgagattgccaatctactgaaagagaaggaaaaactggagtttattttggcagcccaccgacctgcctgcaagatccccaatgacctgggcttcccagaggagatgtctgtgacctccctggacttgactgggggtctgcctgaggctaccaccccagagtctgaggaggccttcaccctgcctcttctcaatgaccctgagcccaagccatccttggagccggtcaagaacattagcaacatggagctgaaggctgaaccctttgatgacttcttgtttccggcatcatctaggcccagtggctcggagactgcccgctctgtgccagatgtggacctgtctggttccttctatgcagcagactgggagcctctgcacagcagttccctggggatggggcccatggtcacagagctggagcccctgtgcactcccgttgtcacctgcactcccagctgcactacctatacgtcttcctttgtcttcacctaccccgaggctgactccttccctagctgcgcagctgcccaccgaaagggcagcagcagcaacgagccctcctctgactcactgagctcgcccacactgctagccctgtgagcagtcagagaaggcagggcagccggcactgactgagctggtgcattacagagaggagaaacacgtcttccctcgaggggttcccgtagacctagggaggaccttatctgtgcgtgaaacacaccaagctgtggacctcaaggacttgaaagcatccacatctggactccagtcctcacctcttccggagatgtagcaaaaaaacaaaaaaacaaaacaaaaaaaaaacaaaacaaaaaatcaaaagcaaccgcatggagtgtattgtttgtagtgacacctgagagctggtagttagtagcatgtgagccaggcctgggtctgtgtctcttttctctttctccttagtcttctcatagcattaactaatctgttgggttcattattggaattaacctggtgctggatatttttcggattgtatctagtgcagctgattttaacaatacctactgtgttcctggcaatagtgtgttccaatttagaaatgaccaatattaaactaagaaaagatagaactttattttccggtagatagaaataaatcgctatatccacgtactgtagctcttcagcgtccatgttcattgtcatgtaactgatcatgcattgttgaggtggtctgaatgttctgacattaacagttttccatgaaaacgttttattgtgttttcaatttatttattaagatggattctcagatatttatatttttattttatttttttctatcctgaggtctttcgacatgtggaaagtgaatttgaatgaaaaaattttaagcattgtttgcttattgttccaagacattgtcaataaaagcatttaagttgaatgcg

SEQ ID NO: 201 - DNA, 463 bp, Rattus norvegicus
catctgcaagcccttgcactacatgaccatcatgagccgacctgtgtgtatattcctagtgggtgctgctgtaatcttaggattcatccatggagcaatacaaactttatttatggcccagttacccttctgtggtcccaatatcatcaaccattttatgtgtgacttaataccactcctggagttggcctgcactgacacacacactctggggcccctgatcgctgccaacagtgggtcactgtgtttgcttactttctctatgctggttgtttcctatgtggtcatccctcgctccctgaggaatcacagttcagaagggcgtcgcaaagctctgtctacctgtgcctctcatgtcactgttgttgtcttattccttgtaccttgttcttacctgtacctaaggcccatgacctccttccccactaacaaagctgtaactgtgttttgcaccctagtgaca

SEQ ID NO: 202 - DNA, 3335 bp, Rattus norvegicus
gtacgcgggtagcacggcctctggccgtggagcaccatgaagtacctggtgagtgtgggcgcggggccggccaggcgggcgggcggtctggaggacgtttcctgggggccccgagtgtcccgccggccgcagagttaccgggcagctcggcacgtaaacgagtccctccctcggtccgcctttcgagtccccgcagctcacggagctagcgtgacgccctccgcagcccttgggtccgggttgcctgagactcagcccgaggcggtatgcagagggactgagaaaccgagatttgctgagggctgcaaaccggcggcgagccgcgacaagaacgtgctggccaaagccctctatgacaacgtagctgagtctccggatgaactctccttccgaaagggtgacatcatgacagtgctcgagcgggacactcagggcctggatggctggtggctctgctcactgcatgggcgccagggcattgtgcctggtaaccgcctcaagattctggttggcatgtatgacaagaagccagcagcacctggaccaggcccacctgccaccccaccccagccccagcccagccttccccagggcgtccatactccagtgcctccagcttcccagtacagtcccatgctccccactgcataccaaccccaacctgacaatgtgtacctggtacccactcccagcaagactcagcaaggtctctaccaagcccctgggcccaacccacagttccagtcacccccagccaaacaaacatccacattctcaaagcaaacacctcatcactcatttcccagccctgccacagacctttaccaggtgcctccagggcctggaagtccagcccaggacatttaccaggtgccaccttccgctggcacagggcatgacatctaccaagtccctccatctttggacacccgcagctgggagggaacgaagccaccggcaaaggtggtggtacctactcgagtgggacagggctatgtgtacgaggcctcccaggcagaacaggatgagtacgacaccccgcgccacctgctagctccaggttcccaggacatctatgatgtgccccctgttcgaggactgcttcccaaccagtatggccaggaggtatatgacaccccgcctatggcagtcaaaggccccaatggccgagacccgttgttggatgtgtatgacgtgccccctagtgtggagaaaggcctgccgccgtccaaccatcattcggtgtatgatgttcctccttctgtgagcaaggatgtgcctgatggcccactgctgcgtgaggaaacatatgatgtaccccctgccttcgccaaacccaagccttttgatccgacccgacatccattaatcctcgctgcacctcctccggactccccaccagctgaggatgtgtatgatgtgccaccccctgctcctgacctctatgatgtgccccctggtttgcggcggcctggccctggaacactgtatgacgtgcctcgagagcgggtgctccctcctgaggtggctgatgggagtgtaattgatgatggtgtgtatgctgtgcccccaccagccgagcgagaggcgccaacagatggcaagcgcctgtcggcctctagcacgggcagcacacgcagcagccaatcggcgtcttccttggaggtagtggtgccaggtcgggagcccctggagctggaagttgctgtggagaccctggctcggctacagcagggtgtgagcaccaccgtagcccaccttctggacctggtgggcagtgccagtggccccgggggctggcgtagtacctctgagccccaggagcctcccgtgcaggacctgaaagctgcagtggccgcagttcatggggcagtacatgagctcctggagtttgcccgcagtgcagtgagcagtgccactcacacttctgaccgcactttgcacgccaagcttagccggcagctacagaagatggaggatgtgtaccagacactggtggtccatggtcaggtccttgacagtggccggggaggtccaggattcactctggacgacctggaccgcctggtggcctgctcacgggctgtgcccgaggatgccaagcagctggcctcctttttgcatggtaatgcctcgctgcttttcagacggaccaaagcccctggccccgggcctgagggcagcagctccctgcacctcaaccccaccgataaagccagcagcatccagtcacgccctctaccctcacctccaaagttcacctcccaggactctccggatggccagtatgagaacagtgaagggggttggatggaggactatgactacgttcatctgcaggggaaggaggaatttgagaagacccagaaggaactgctggaaaagggcaacatcgtgcgacagggaaaaggccaactggagctgcagcagctgaaacagtttgagcgactggagcaggaggtgtctcgtcccatagaccatgacctggccaactggacaccagcccagccccttgtgccggggcggacagggggactggggccttcagaccgacagctgctgctcttctacttggagcagtgtgaggccaacctgaccacactgacagatgcggtggacgccttcttcaccgcagtggccaccaaccagccacccaagatctttgtggcacacagcaagtttgtcattcttagtgcacacaagcttgtgttcattggggacacactgtcacggcaggcaaaggcagctgatgtgcgaagcaaagtgacccactacagcaatctgctgtgtgacctcctgcgtggcatcgtggccaccaccaaggccgctgccctgcagtacccatccccatctgctgcccaggacatggtagacagggtcaaggagctaggccacagcactcagcagttccgccgtgtcctgggccagctggctgccgcctgaaagcagaagactgggctgtgaggctggggagtgggtagcggtggtgtgagctacccaggcgctcgtcttgaagtggagatcctgcaggtttggggacaggtaaccccagctctgctttgggcctggtgccctcaactgtccagggatttgtacatatttatatcaaggcaggatgcagaatgcctcctcggagaggctgaggagccccgtcagagtggaccatgggctgggatcaccagggttggggcacatgggctccagtccacagggctccctgggacaggaagtacagtgtggtgtacacctctgcaccaagaaaacctaaagaactatttttcactattgatttttttccaatcatttgactaatagtctacatttaataaaatttt

SEQ ID NO: 203 - DNA, 464 bp, Rattus rattus
attaactattcctttattaggtggtaagggaactgggaaggtgagggttgtacagtgcaggacctgggagttcagctacaatggactgtgaccaggtgccatattagaaacatttctatcaggcagtgaggctgagccaaggggataacaggaagagggagcgccactcccactttcagccctgtatttacaattagaagtggaatgcatacaaaatacaactcccctgacgtgccccacccaggccctaaaaggcgagccaggctctgggaggtgggcctgcagtggaggctttgggcaggaaagacccctttcccaatgagtctacaagtcttgtctggaatgcagtgaagtgaggaaggaggatggggaggcgggggaggctcccaagtgtcccctgaccccaggggagggtgtgcccaaggctggctacttggtacgcaccggggccacgtactcaatac

SEQ ID NO: 204 - DNA, 4008 bp, Rattus norvegicus
cccgggcagcgcgctctgcggtcgcctaccgcctgccgcccccgcgccgccgcgacgtggcaggaggcgatgcggcggcgccgctacctgcgggaccgcgccgaggcggcggcggcagcggcggcgggaggcggagaggggctgcagcggtcccgggactggctctacgagtcctactactgcatgagccagcagcacccgctcatcgtcttcctgctgctcatcgtcatgggcgcctgcctcgccctgctagccgtcttcttcgcgctcgggctggaggtggaagaccatgtggcatttttaataacggttcccactgccctggccattttctttgccatattcattcttgtctgcatagagtctgtgttcaagaagctactccgtgtgttttcgctggtgatttggatatgtctggttgccatgggatacctgttcatgtgcttcggagggactgtgtctgcctgggaccaggtgtcattcttcctcttcatcatctttgtggtatataccatgcttcccttcaacatgcgagatgccatcattgccagcatcctcacatcttcatctcatacgatagtgctgagcgtctacctgtctgcaacaccaggggccaaggagcacctgttctggcagatactggccaatgtgatcattttcatttgtgggaacttggcgggagcctaccacaagcacctcatggagcttgccttgcagcaaacctatcgggacacgtgtaattgcatcaagtcccggatcaagctggaatttgaaaaacggcagcaggaacggctcctgctctccttgctgccagctcacatcgccatggagatgaaagctgaaatcattcagaggctgcagggccccaaagcaggacagatggaaaacacaaacaacttccacaatctgtatgtcaaacgacacaccaacgtgagcatattatacgctgacattgttggcttcacccgccttgcaagcgattgctcccctggcgaactggtccacatgctgaatgaactctttgggaagtttgatcaaatagcaaaggagaatgaatgcatgagaattaaaattttaggagactgctattactgtgtttccgggctccctatatcactccctaaccatgccaagaactgtgtgaaaatgggattggatatgtgcgaagccataaagaaagtgagggatgctaccggagttgatatcaacatgcgtgtaggagtgcattctgggaacgttctctgtggtgtgattggtctccagaagtggcagtatgatgtgtggtctcatgatgttactctggcaaaccacatggaagctggaggagtccctgggcgtgttcacatttcttcagtcactctggagcacttgaatggggcttataaagtggaggaaggagatggtgagataagagacccatatttaaagcagcacttggtgaaaacctactttgtaatcaatcccaagggagagcgacggagtcctcagcatctcttcagacctcgacacactctggacggagccaagatgagagcatctgtccgcatgacccggtacttggagtcctggggagcagccaagccattcgcacatctgcaccacagagatagcatgaccacagagaatgggaagattagtaccacggatgtgccaatgggtcaacataattttcaaaatcgcaccttaagaactaagtcacagaagaagagatttgaagaagaactgaatgaaaggatgatccaagcaattgatgggatcaatgcacagaagcaatggctcaagtcagaagacattcaaagaatctccctgcttttctataacaagaatatagagaaagaataccgagctactgcactgccagcattcaagtactacgtgacctgtgcctgcctcatctttctctgcatcttcattgtacagatacttgtattgccaaaaacgtccatccttggcttctcctttggagctgcatttctctccctcatcttcatcctctttgtctgcttcgctggacagcttttgcaatgcagcaaaaaggcctccacctctctcatgtggcttttgaaatcatcaggcatcatcgccaaccgcccatggccacggatctccctcacaatcgtcaccacggctatcatactaaccatggctgtgttcaacatgtttttcctgagcaactctgaggagacaacccttcccactgccaatacatcaaatgcaaacgtttctgtcccggataaccaggcgtcgattcttcatgctcgaaacttgtttttcctcccgtacttcatatacagctgcatcctgggcttgatctcctgctccgttttcctgagggtgaactatgagttaaaaatgttaatcatgatggtggcactcgtgggctacaacaccattctactccacacccatgcccatgttctggatgcgtacagccaggtcctgtttcagagaccaggcatttggaaagacctgaagaccatgggctccgtgtcactctccatattcttcatcacgctgctggttctgggcagacagagtgaatattactgtaggttagacttcttgtggaagaacaagttcaaaaaagagcgggaggagatagaaaccatggagaacctaaatcgagtgctgctggagaacgtgcttcctgcacacgtggctgaacacttcctggccaggagcctgaaaaatgaggagctgtaccaccagtcctacgactgtgtctgtgtcatgtttgcctccattccggacttcaaggagttctacacagagtcagatgtgaacaaggaaggcttggaatgcctgcggctcctgaatgagatcattgctgactttgatgatctgctttctaagccaaagttcagtggtgttgaaaagatcaagaccattgggagcacatacatggcagccacgggactgagtgccatacccagccaggagcacgcccaggaacctgagcgtcagtacatgcacataggcaccatggtggagtttgcatatgccctggtgggaaaactggatgccatcaataagcactccttcaacgacttcaaactgcgagtgggtatcaaccatgggcctgtaatagctggcgtcataggggctcaaaagccacagtatgacatctggggcaacactgtcaacgtggccagcagaatggacagcaccggggtcctggacaaaatacaggtgactgaggagacaagcctcatcttgcagacgcttggctacacgtgtacatgtcgaggtatcatcaatgtgaaggggaaaggggacctgaagacatattttgtaaacacagagatgtcaaggtccctttctcagagcaacttggcatcctgagaagctgtctcttcctgacaagaagaatgtacttgcaggaaggtaccacgcactttctgactgcaacccttccccttcgtcctgatgtacgtgctctgccccatcctctggagcccctgcagactagttcctgtgacccagtgacatactgtttggtgtctgcgcgtgcccaggttgtcctgccacttgcactgtgcttgctcctaagcaggaggggaaggaaccatgtcctggaaggagagcattggaagaagtgatgaagaggtgaagtgaacacacattcttaaggcaataaaaccggggggtgtatattatcttctggtgcatgttcttctctggaaaatacggtagctcgtaactgcatccctagtctgatattcaaacacacagtatttgtgaataagctgatcccgtcacccaacatggagtctgtgttcacctacccatgtgtctcattgccagtggtcgtccttgggggctcagctgagactctcagcttctgtcaccttgctgtcctgtcttgtggcagcagcacgttgccatccatcaccagaattagtcctcacagcctaggaccagttttgtaccaaactcatctgatgttttgatgccatttgtcaaaagtaaggttaattcattaaaagttttatgtactttgaaaaaaaa

SEQ ID NO: 205 - DNA, 1098 bp, Rattus norvegicus
gatagtgaattcgtgttgctttcaaggtcatgctggtgggggattccggtgtggggaagacgtgcctgctcgtgcgcttcaaggatggggccttcctggctggtaccttcatctccactgtgggcatcgacttccggaataaagttctggatgtggatggcatgaaggtgaagctgcagatctgggacacggctggtcaggagcggttccgaagtgtcacccatgcctactaccgggatgctcacgcactgttgctgctctacgacatcaccaacaaagattccttcgacaacatccaggcctggttgacagaaatccaggaatatgcccagcaggacgtggtgctcatgctgttggggaacaaggttgactctactcaagaacgagtggtaaagagggaagatggggagaaattagccaaggagtatgggctgccattcatggagaccagcgccaagagcggcctcaatgtggacttggcttttacagccatagcaaaggagctgaaacaaagatccaccaaggctcccagtgagccgcgcttcaggctgcatgactatgtgaagagggagggccgaggggtctcctgctgtcgactctgaacctagctgaatttcggttctacgctggaggcagctgtttgggataccataggtgatggatgccagaatgtcttccttttcaagacacctgaggctgatgctcttcagccccttggcctcaggggccatcacagaaagcatacaaaccacactatggcctgtggctgccctcttctgggcactcccagcaggaaggatggcaccacattcgtgcctcctatgaaaagccatgcttactgcacacggcctgggaaggaccccacacacgaccaaaggctacaagaatcatgttgtccatttgttgggttgcttccaagtcaactagtaggctctgatgtaggaaaccacaggaagattgggctgatagaaccaggtcactacttagcaggctggcccagtccttcccaccttgtactaaagtcaccagactacaaatgttgtgtgaaaacctgtccccattaataaaggtgtttctgcccgggaattcgcggtcacc

SEQ ID NO: 206 - DNA, 1561 bp, Rattus norvegicus
ggacactagaatgctgtgttgttagaggagtggagagaggaagatgtgctaagtgtagcagtacacacctataatcctagcacttgagaggttgaaggcaggaggatgagacattcaggtcattcttagctacatgaagagtttaaggccagcacggattacaggatatctgtttctggggaaaaaggaggggaagagagagaggaaagggcaaagggcagagtgtgggctccctgtcgtcagggcaagagaactatggtgatccagccgtctctgctgctccttttgctgttgactctacaggatgtggacagctgccaggggccagaacttgtccgggagcttgtcctggccaaagtgaaggcactattcctagatgccttggggcccccagcaatggatggggaaggtgggggtcctggaataaggcggctgcctcgaagacatgcccttgggggcttcatgcacaggacctctgaaccagaggaggaggatgtctcccaggccatccttttcccagccacaggtgccacctgtgaggatcaggcagctgctggagggcttgcccaggagcctgaggaaggtctcttcacttatgtattccggccatcccaacacatacgcagccaccaggtgacttcagcccagctgtggttccacacggggctcgacaggaagagcacagcagcctccaatagctctaggcccctgctagatcttctggtgctgtcatctggggggcccatggctgtgcctgtgtccttgggacagagccccccacgctgggctgtcctgcacctggcggcctccgctttccctctgttgacccaccccatcctcgtgttgctgctgcggtgcccactctgttcttgctcaggccggcctgagaccactcctttcctggtggcccacactagggctcgagcccccagtgcgggggagagggctcgacgttcagctccctcgatgccttggccttggtctcctgcagccttgcgtttgctgcagaggcctccagaggaaccctctgcccatgccttctgccatcgagctgccctcaacatctccttccaggagctgggctgggaccgctggatcgtacaccctcccagcttcattttccactactgccatggtagctgcgggatgcccacatctgatctgcccctgccagtccctggggctccccctaccccggctcagcccctgtttttggtgccaggggccaagccctgctgtgcagctctaccagggagcatgaggtccctacgcgtccgaaccacctcagatggaggctactctttcaagtatgagatggtaccgaacctcattacacaacactgtgcttgtatctaaaagcacctcgtctcctcctccacagccactggccaccatcacctcaccatcccacggtcggtcggtcggtcggtcgtcagctaggaggaaggtgggtgtggaaagtagacagtttccacttccttttcccttcatctttctgtctgaggcttccacaccccactccacccaggtcctgtggataacaataaagaaggaagtgtgt

SEQ ID NO: 207 - DNA, 9695 bp, Rattus norvegicus
cggcacgagcggctaggttaggagcccctggcgcgccgcgccctcggtgccgggccgcggagccggggatgcgcgcggcgccccgggagtcatggtccgcttcggggacgagctaggcggccgctatgggggcaccggcggcggggagcgggctcggggcggcggggccggcggggccggtggcccgggccaggggggtctgccgccgggccagcgggtcctgtacaagcagtccattgcgcaacgcgcacggaccatggccctgtacaaccccatcccagtcaagcagaactgcttcaccgtcaaccgctcgctcttcgtcttcagcgaggacaacgtcgtccgcaaatatgctaagcgcatcaccgaatggccgcccttcgaatatatgatcctggccaccatcatcgccaactgtattgtcctggccctggagcagcacctccctgatggggacaagactcccatgtctgaacgactggatgacacggaaccttacttcatcggcatcttttgcttcgaggcgggcatcaagatcatagctctgggcttcgtgttccacaaaggctcctacctccggaatggctggaacgtcatggacttcgtggtggtcctcacagggattcttgccacagctggaactgactttgatctgcgcaccctgagggctgtgcgtgtgcttaggcccctgaagttggtgtctggaattccaagcttgcaggtggtgctcaagtccatcatgaaggccatggtcccgctgctgcagatcgggctgctgctcttcttcgccatcctcatgttcgctatcatcggcctcgagttctatatgggcaaattccataaggcctgcttccccaacagcacagatgcagagcctgtgggtgactttccttgtggcaaggaggcccctgctcgtctgtgtgacagtgacaccgaatgccgggagtactggccaggacccaactttggcatcaccaattttgacaacatcctgtttgccatcttgaccgtgttccagtgtatcaccatggagggctggactgacatcctctacaatacaaatgatgcggccggcaacacgtggaactggttgtacttcatccccctcatcatcattggctccttcttcatgctcaacctggtgctcggtgtgctttcaggagagtttgccaaagagcgggagcgagtcgagaaccgccgtgccttcctgaagctccgcaggcagcagcagattgagcgagaactgaatgggtacttggagtggatcttcaaggcggaggaagtcatgttggcagaggaggacaagaacgcagaagagaagtcccctttggatgtgttgaagagagctgctaccaagaagagccgaaatgacctcatccatgcagaagagggggaggaccggtttgtagacctctgtgctgctgggtctccctttgctcgtgccagcctcaagagtgggaagacagagagctcatcgtacttccggaggaaggagaagatgttccggttccttatccgtcgtatggtgaaagcacagagcttctactgggtggtactgtgcgtggtggccctgaacacgttgtgtgtggccatggtacactataatcagcctcagcggcttaccactgcactgtactttgcagagtttgttttcctgggtctcttcctcacagagatgtccctgaagatgtacggtctagggcccagaagctacttccggtcttccttcaactgctttgactttggggtgattgtggggagtatctttgaagtagtctgggctgccatcaagccaggaacctccttcggaatcagtgtgctgcgggctctccgactgctgaggattttcaaagtcaccaagtattggaactccctgaggaacctggttgtttccctcctcaactccatgaagtccatcatcagccttctcttcctgcttttccttttcattgtggtcttcgctctgttggggatgcagctgtttgggggacagttcaactttcaagatgagactccaaccaccaattttgataccttcccagctgccatcctcactgtgtttcagattctgacaggagaggactggaatgcagtcatgtatcatgggattgagtcacaaggaggagtcagcaaaggcatgttttcatccttttacttcatcgtcctgacactgtttggaaactacaccctgttgaacgttttcttggccattgctgtggacaaccttgccaatgcccaggagttgaccaaggatgaagaggagatggaagaggcagccaatcagaagcttgctcttcagaaggccaaagaagtagctgaagtcagccccatgtctgctgccaacatctccattgctgccaggcagcagaactcggccaaggcgcgctcagtatgggagcagcgggccagtcagctaaggctccagaacctgcgtgccagctgtgaggcactgtacagtgagatggacccggaggagcgcctgcgttatgccagcacgcgccacgtgaggccagacatgaagacacacatggaccgacccctagtggtggaacctggtcgggatggcctgcggggacccgccgggaacaagtcaaagcctgagggcacggaggccaccgaaggtgcggatccaccacgccgacaccaccggcatcgtgatagggacaagacctcagcctcaacccctgctggaggcgaacaggacaggacagactgcccaaaggccgaaagcaccgagaccggggcccgggaggaacgtgcgcgccctcgtcgaagtcacagcaaggaggctccaggggctgacacacaagtgcgttgtgagcgcagtagacgtcaccaccggcgcggatccccggaggaggccactgaacgggaacctcggcgccaccgtgcccaccggcacgcacaggactcaagcaaggaaggcaaggagggcactgcaccggtgcttgtacccaagggcgagcgtcgcgcaagacatcgaggcccgcgtacgggcccccgtgagacagagaacagtgaggagcccacacgcaggcaccgtgcaaagcataaggtgccaccaacacttgagcccccagagagggaggttgcagagaaggagagcaacgtggtggaaggggataaggaaactcgaaatcaccagcccaaggaacctcgctgtgacctggaggccattgcggttacaggcgtgggctctctgcacatgctgcccagcacctgtctccagaaagtggacgaacagccagaggatgcagacaaccagcgtaatgtcacccggatgggcagtcagccctcagaccccagcaccactgtgcatgtcccagtgacactgacaggccctcccggggaggccactgtagttcccagtgctaacacggacctggaaggccaagcggagggcaagaaggaggcagaggctgacgatgtgctgagaagaggccccaggcccatcgttccctacagttccatgttctgcctcagccccaccaacctactccgtcgcttctgccattacattgtgaccatgcggtactttgagatggtgattcttgtggtcatcgccttgagcagcattgccctggctgctgaggatcccgtgcggaccgactcattccggaacaatgctctgaagtacatggactacatctttacaggagtcttcacctttgagatggtcataaagatgatagacttgggcctgctgctgcaccctggggcctacttccgggacctgtggaacattctggacttcattgttgtcagtggagccctggtggcatttgcattctcaggatccaaagggaaagacatcaataccatcaagtctctgagagtcctgcgagtcctgcggcccctcaagaccatcaagcggctgcctaaactcaaggctgtgtttgactgtgtggtgaactctctgaagaatgtcttgaacatcctgatcgtctacatgctcttcatgtttatatttgccgtcatcgccgtccaactcttcaaagggaagttcttttactgcactgatgagtccaaggagctggagcgggactgcaggggtcagtatttggattatgagaaggaagaggtagaagcccagccaaggcagtggaagaaatatgacttccactatgacaatgtgctctgggccttgctgactctgtttacggtgtccacaggagaggggtggcccatggtgctgaaacactctgtggacgccacctatgaggagcaggggccaagccccgggtttcggatggagctttccatcttctatgtggtctactttgtggtcttcccttttttctttgtcaacatctttgtggccttgatcatcatcaccttccaggagcagggggacaaggtgatgtctgagtgcagtctggaaaagaatgagagggcttgcattgactttgccatcagcgccaaacccctgacacggtacatgcctcagaacaagcagtcgttccagtataagacatggacatttgtggtctctccaccctttgagtacttcattatggccatgatagccctcaacacagtggtgctgatgatgaagttctacgatgccccttatgagtacgagctgatgctgaagtgcttgaacatcgtcttcacatccatgttctctctggagtgcatcctgaagatcatcgccttcggggtgttgaactacttcagagatgcctggaacgtctttgactttgtcactgttttgggaagtattactgatattttagtaacggagattgcggaaacgaacaacttcatcaacttgagcttccttcgcctcttccgggcagcacggctgatcaagctgcttcgccagggctacaccatccgcatcttgttatggacctttgtccagtcctttaaggcgctgccctacgtgtgcctcctcattgccatgctgttcttcatctacgccatcatcggcatgcaggtttttggaaacattgcccttgatgatggcaccagcatcaaccgacacaacaacttccggacatttctgcaagccttaatgctgttgttcaggagtgccactggggaggcctggcacgaaatcatgctgtcttgcctgggcaaccgggcctgcgacccacatgccaacgccagcgaatgcgggagcgactttgcctatttttattttgtctccttcatcttcctctgttcctttctgatgctgaacctctttgttgctgtgatcatggacaatttcgaatacctcacgcgggattcttccatcctagggccgcaccacctcgatgaattcattcgcgtctgggctgaatacgacccagctgcgtgtgggcgcatcagttacaatgacatgtttgagatgctgaaacacatgtccccacctctgggtttggggaagaaatgcccggctcgagttgcatacaagcgcctggttcgaatgaacatgcccatatccaatgaggacatgacggtacactttacatccacactgatggccctcatccggacggcactggagatcaagcttgccccagcggggacaaaacagcaccaatgtgatgctgagctgaggaaggagatctcttctgtgtgggctaatctgccccagaagactctggacttactggtgccaccccacaaacctgacgagatgacagtggggaaggtctatgcggctctcatgatatttgacttctacaaacagaacaaaaccaccagagatcagactcaccaagctcctggaggcctgtcccagatgggtcctgtttccctgttccatcctctgaaggccaccctggagcagacacagcccgctgtgctccgaggagctcgggttttccttcgacaaaagagtgcaacttccctcagcaatgggggcgccatacaaacccaggaaagtggcatcaaggagtccctgtcctggggcacgcagaggacccaggacgtactttatgaggccagagcacctctagaacgtggccattctgcagagatccctgtggggcagccaggagcactggctgtagatgtccagatgcagaacatgacattgagaggaccggatggggagccccagcctggcctggagagccaaggccgagcggcctctatgccacgcctggcggcagaaacacagccggcccctaatgccagccccatgaagcgctccatctccacactggctccacgcccgcatgggactcagctttgcaacacagtcctggaccggccacctcctagccaggtgtcccatcaccaccaccaccgctgccaccggcgcagggacaagaagcagaggtccctggaaaaggggcccagcctgtctgttgacacagaaggtgcaccaagtactgctgcaggatctggcctgccccatggagaagggtccacaggctgccggcgggagcgtaagcaagagcgaggccggtcccaggagcggaggcagccctcctcctcttcttcagagaagcagcgcttctattcctgtgaccgctttgggagccgggagcccccacaacctaagccctccctcagtagccaccccatatcgccaacagcggcactagagccaggaccccacccgcagggcagtggttccgttaatgggagccccttgatgtcaacatctggtgctagcacgccgggccgaggtgggcggaggcagctcccccagactcccctgaccccacgccccagcatcacctacaagacggccaattcctcgcctgtccactttgctgagggtcagagtggccttccagccttctcccctggccgtctcagccgcggcctttctgaacacaatgccctgctccagaaagagcccctgagccagcctctagcttctggctcccgcattggctctgacccttacctagggcagcgtctggacagtgaggcctctgcccacaacctgcctgaggatacactcacctttgaagaggccgtggccaccaactctggccgctcctccaggacttcctatgtgtcctccctcacttcccaatcccaccctctccgccgtgtacccaatggctaccactgcactttgggactcagcaccggcgtccgggcgcggcacagctaccaccacccagaccaggatcactggtgctagctgcaccacgaccacccatgcaccagctcgtgggtgcgggttccagttgatgagttttatcatccgctctgggttgtgcggtcacagccctgggaggagggtcctcacatcgcggcctctgtggtggaggttcctgcttctctccctccctcccttttacactggacagactaataaagccctttcttagagggatatggtcctctctatcctcctgtgtactgccttcctgggttccatgccagatgttggatcctaagcagaggtagctgagttgagatagacccagcaaatccaaatcctatgtcatggcctccagcttccagggtgggtacttgggactttcttaggaggtctgagcctcatggagattgtggtttgtccaaatgtgtggcatgggggatagggtaccctcaaaggcaaggaaaggagcccaactgtgtggcctggcagcacctgccagcatcactactctcatgtctattgtggtcttggagtcaaacagcacatgtatatagagatatgctcaagggcctgcctttcacctacattgtcaccataatagggaccaaatctagaggatgtccttgctgttgattctggttttcagtcacaacactttcactttttgtcatttctatatagttgatctagaaaaacagaaatcaaaacagggaagaaaatgttcgtgtaacttaaaaaagaaatcaacgtgtaggaaggtctccattttgcattgtttctgtgacttgtatgcaatgttcctgtatgtattctacccttcccgggaagtccccaatgaccctggttcctctgctcaaccaagtgcctgatctctggctctgagcatcgtggctgaggtgcggcctcaggaagcatcggggagctgctcagagcagcactaggacttgtgtcttagggacactgaccgtgtccagcagcatgtcagagaagcagctgtagtgcccatgttcctccctgagtgatgggttctgaagaagccagagcagcacaatgtgtgcttgcgtgaggcactttccgccttttaaaatctgattctcagggatgggatgcctgccaagtagggtgtgatctctgttgtgttttaaaaaacaacaacaacaaacaaacaaaacctagtattcactgaatgctgaagagagcaaaatgcaagcaaagaagggactggggttagagggagaagcccgcactggcagcataataagaaactggcagggaggggatggtcctggaacaggccaggtgcctagagctgagtccagcccctggcccggaactggggacacagcactcaaataaaacctcatggctacttggtgaaaggcaaacccatgctcaggaaggtgttcagtgtgcagagatggctgtgaggccatgagagaaaggtttcacataggcaggcagtccttggtgtgttctctgtgttttgaaacgtctgatgacttcttggtggactgttggtttctaccccatgtttctcacagaagctgtgtatatgtgtgattgcgcgtgtgattgcatgtgtgtggtagtgtgcgtgcgtgagcatgcatgagtcataggaaatgtgtgtgtgtgtgtgtgtgtgtgtgtaggtgtgtgtacgtgtgttcagcaagtggcttttgtcaaccatagggctatgcaacaaaagacacattactagaaacaaaacacaagaccaccactcggtctagggtttcagcatgattgtgaccaaaccttttatagaatttccttatatgaaggcacaataccctgaaactttaaagataacagagtattttattccagtagggtaagattaaacaggaccctggactgcatgtgactgcactcatgtacaacagaggaggatgtgcattttgatactgttctgtctctgtcccagccccagcccttttctcttgagtgttgaatgtatacattctgtgtggaactacagctgctccagacagtcctgggttgggaatcatctttatcccacattaacatagctggcttttcttccaagcactggtacacaggaaaggagacatgatgtcttgcttcctgactttgggtttgtttctgtactgtctcttctcaagatgttgtctgttccccctgaaatttcatagtgagttgccaaatttgaaatgcaacaaccagctgtctgcatctggaacctgtcaagcagtgctgtagtttgaaaaagttatgtgtgcatgtaaaatatacacatatatatatatacattatacaagtatgtgcatgaaatgtatatcttcatactttttgatacaatgtattcatttgttaatttttaattatatttgatataaattgaaggtttgttgcaaaaatttatatttaacagtgttgagagagagagaaagagcgagagagggagagagagagaaagatccaatcatgcaacagaaatgggactactttaaaaatcagtcctttgactagtttgctgccctgaataatatttacaaaccaaactttggattctgctcttgtttctacaatgactttttgtataaagcaaagtccttggattaataaaacaaccaaaaatcaaattaaaccatta

SEQ ID NO: 208 - DNA, 568 bp, Rattus rattus
gagtggcagagaaatgttttttaatttggaaagtaagggttacactgaggggaggcagattctgtgttaacagacgcgcactgtggagttggtccaacagagcaaagggagttctctggacgccccacctcacgtccagcaagagtcatagctgagcacgagtctgaagaatccatgtacaacaagctgccagctcaagaattctgatccaggagacgtcaaagagtgagcactctgccagtctccaactccacggtaaggaaatgggagcggctcagccgacgaagttcatgacgacgaggtgcaggatagtgctggcaaagagaaaatcagcaaaggctcgctcaggagagatgccttggaaatccgccttgttctgggggttgatctgtattctcaagcaaaccgctaagatgaagctgcccacacaagagatgaagccagagaggaaagagttgaaggggaaggtgcccacgaggagacagtagccgaactgcagcgccccggtcagcaatatataaaggagataggcatccagcaacttcagccgctgtggagtggagctcaa

SEQ ID NO: 209 - DNA, 599 bp, Rattus rattus
agtatggtcacaagtttgacacctacatgtcgccattaacagagctgacgacaaatattggaaataagtgaattactgaagtatggcaagatttaaaatgtcaacttggagtgatcatgcaagcccatgcattggtgcctgcgccctaattgcaggacccactctgctcatccttgtggctctgtaccctcagcggggttgggtagggccaccctgccttttcgcagatccagaattttaagggcaagtgtggagccttccttggagcatggtcgccatgcctggtttctgcttggggtaaaactgtggctattgctagtatgagccgcaggattcccagggcttgtgctaacagagtgttctcgtgtccctgcaaaaggcctccaggcagttttgcatctgtgtttcctcctggggagtctacaagtgaggtgcacagtcttccagcatgctgtcagtgatgtagctggacccaaggtgggactcgtagtaattcttttcatcaaaggtattgacagtccaactaacaacctggattcctttggctgaccacttcttcaaatagtacggggagacaaaatccttctgcatgaggaagg

SEQ ID NO: 210 - DNA, 3561 bp, Rattus norvegicus
ggaattcggcacgagtcgggcttctaggaggttctgaggcagaagctctcagttccattcgatgtcttcataaagaagcgctcgcgggcacggagcctgccatcgggccatggagaagcagaagccttcacgttgttcgtcccaccgagactgagcagcagtcaagtgtcggctgtgaaacctcagacggcgggaggagactccaactacttcaagactgtcaacaaatgcacagaaggtgattttggtgttccattgacaatgtccagtctatcaaaaaatcgggaaaacattgatacagatcccgcttttcaaaaacttagcattttgcccatgcttgaacaggttgcaaattctggcagttgccactatcaggaaggagtaaatgactctgattttgagaattcagagccaatgagcagactgtactcaaagctgtataaagaggctgaaaagataaaaaagtggaaagtgagcatagagtctgaactgaagcagaaagaaaataagttgcaagaaaacagaaagataattgaagcccagcgaaaagccattcaggaacttcagtttgaaaatgaaaaagtaagcttgaaattagaagaagaaattcaagaaaataaagatttaatcaaggagaataatgctacaagacattggtgtaatttactcaaggaaacctgtgctagatctgcagaaaagacaagtaaatatgaatatgagcgagaagaaaccagacaagtttatgtggatctaaataataacattgagaaaatgatactagcttttgaggaacttcgtgtgcaagctgagaatgccaggctggaaatgcactttaagttaaaggaagatcatgaaaaaatccaacatcttgaagaagaatatcagaaggaagtaaacaacaaggaaaaccaggtatcactactattgatccaaagtactgagaaagaaaataaaatgaaagatttaacatttctgctagaggaatccagagataaagctaatcaattagaggaaaaaacaaaattacaagatgaaaacttaaaagaattaaatgaaaagaaggatcatttaacatcagaacttgaagatattaaaatgtccatgcaaagaagtatgagcactcagaagactttagaggaagatttacagatagcaacaaaaacgatttatcagctcactgaagaaaaagaagctcaaatggaagaactcaacaaagctaaaactactcactcacttgtggtgactgaacttaaagccactacatgtaccttggaggaattactgagaacagaacagcaaagattggaaaataatgaggatcaactgaaactgattactatggagctccagaagaaatcaagtgaactagaagagatgactaaatttaaaaataacaaagaagtggaacttgaagaattaaaaaccatattggcagaagaccaaaaacttttagatgaaaagaaacaagttgagaagcttgctgaagaattacaagggaaagaacaagaactaactttccttttgcaaaccagagagaaagaaatccatgatttggaagtacaagtaactgtcactaaaacaagtgaagaacattatttaaaacaggttgaagaaatgaaaactgagcttgaaaaagagaaacttaagaatattgaattaactgcaaactctgacatgcttttgcttgagaacaaaaaattggtacaagaagcaagtgatatggtcctagaactcaagaaacatcaagaagatatcattaattgcaaaaagcaagaagaaaggatgttgaaacaaatagaaactttggaagaaaaagaaatgaatttaagggatgaactggaatcagtaagaaaagagttcatacagcaaggagatgaagttaaatgtaaattggacaagagtgaagaaaatgctcgaagcattgaatatgaagttttaaagaaagaaaagcagatgaagatattagaaaataagtgtaataatttaaagaaacaaatcgaaaataaaagcaagaatattgaagagcttcaccaggagaataaagccttgaaaaaaaaaagttcagcagaaaacaaacaactgaatgcatatgagataaaggtcaataaattagagttggaattagcaagtaccaagcaaaaatttgaagaaatgattaacaactaccagaaagaaattgagataaaaaagatttcagaagaaaagcttttgggagaggttgagaaagccaaagcaacagttgatgaagccgtaaagttacagaaagaaattgatttacgatgccaacataaaatagctgagatggtagcacttatggaaaaacataagcaccaatatgataagattgttgaagaaagagactcagaattaggactttataaaaacagagaacaggaacagtcttcagcaaaggttgctttggagactgaattatctaatatcagaaacgaacttgtatcccttaagaagcaacttgaagtagaaaaagaagaaaaagagaaattaaaaatggaacaagaaaacacagctattctcacagataaaaaagacaagaaaatacaggcatctttgctggaatcacctgaagccactagttggaaatttgattctaaaacaactccctcacaaaatatatctcggctttcctcatcaatggatagtggcaaatccaaagataacagagatagtctgcgggcatctgccaaaagcattttatctacaacagttacaaaggaatatacagtgaagacaccaactaaaaagagcatatatcaaagagaaaacaagtatttacctactggaggaagtaataaaaagagaaaaactgtctttgaatttgatgttaattcagatagttcagaaactactgatcttttgagcttggtttcagaggaagatatatcaaacaggatttataataataatacaccagattctcatctattagtcaaaactcccaaacagactcctttatctttatcaactcctgcatcttttacgaagtttggaagtctgaaaaaaatgagagaagaccgttgggcaacgattgctaaaattgataggaaaagaagactaaaggaagcagaaaagttatttacttaatttcagaaaatcaatgttggttatagagactaatagttaactttattatttcccagagagccaaactttactgaggaattcagactttaaaattaattacataaataatttgtttgttatgtttgtggtctaaatataaagtaactatatttgaatttttttattgtattcagatacttagattttgttgcttttacttgcaatggatattgaaattcaaaggttttttttgtttttgtttttttttttttttgtcttctcctccctacccccaagagctgaggaccaaacccagtgctttgtgcttgctaggcaagcgctctaccactgagcttaatccctaaccctgaagttcaaattttttattttgagcttttgaccattagaaatgcattatcgagacttataatttattctttattattaaaatattttggatgcaaaaaaaaaaaaaaaaaa

SEQ ID NO: 211 - DNA, 1082 bp, Rattus norvegicus
gaattccggagaatcttctttcgtctgctcgctctctctcccgtcgtcctagcccgccgccgcctgctgagcttgccctctccccgcttgcagacatggctgacatcaagaacaaccccgaatattcttcgtttttcggtgtcatgggcgcctcgtccgccatggtcttcagcgccatgggagctgcctatggcacagccaagagtggcactggcatcgcagccatgtcggtcatgaggccagagctgatcatgaagtccatcatcccagtggttatggctgggatcatcgccatctacggcctggtggttgcagtacttatcgctaactccctgactgatggcatcaccctctacaggagttttcttcaactgggtgctggcctgagtgtggggctgagtggcctggctgctggctttgcaattggcattgtcggagatgctggtgtccggggcactgcccagcagcctcgactgttcgtgggcatgatcctgatcctcatctttgcggaggtgcttggcctctacggtctcatcgtggccctaatcctctccacaaagtagtcttttccaccaccagtcacaggataggatgtaaagatcacccctcctcattccagaaggaacagcctgacacatgcacgggcagctgcccctcagtagttggtcttgtaaatgtgcagtgtccctagtgccattgtctgttgccccgccttgcccctactgccccgtgctgtggacatctgggcccactcatctcccacccaggcccctgaccagtgacgatttcagcctctggtcaccccacccatcgccctagagtgcgccttgtgtataagaatgaattagagttgtcatttttctcttcactggatgtttatttataaaagatttgacctattcatgtgtctgtggagcagccctgtctcccaactctatagtaatcattagtagactgttgccttgtggggttcctgttgctgagactccttggatggagccaccctgcccccagccctgaacagccgggggggggtagagagttcctcagagctggctcccagctgtgtccaataaaagttc

SEQ ID NO: 212 - DNA, 846 bp, Rattus rattus
cgttgctgtcgggcgctggccagcgtgttgcagcggccgatgccggtgaatcagcacgggttttttggactcggaggtcgtgcagatctgctggacttgggtccggggagtcctggtgatgggctgagcctagccgcgccgagctggggtgtcccggaggagccacgaatcgaaatgcttcatggaaccaccaccctggccttcaagtttcagcatggagtcattgttgcagcggattcccgggccaccgcaggtccctacattgcttcccagacagtgaagaaagtgatagagatcaacccttaccttctgggcaccatggctgggggtgcagcggattgcagcttctgggagcggttgttggctcgacagtgtcgaatctatgagcttcgcaacaaggaacgcatctcggtcgcggcggcctccaaactgcttgccaacatggtgtatcagtacaaaggcatggggctgtccatgggcaccatgatctgtggctgggataagagaggcccgggcctctactatgtagacagtgaggggaacaggatctctggaaccgccttctcagtgggatctggctccgtgtatgcgtttggagtcatggatcgaggctactcctatgacctacaagtggaggaggcctatgacctggcccgccgagccatctaccaagccacctacagagatgcctactccggaggagcagtcaacctctaccatgtgcgggaggatggctggatccgtgtctccagtgacaatgtagctgacttacatgacaagtatacttcatctatcccctgagggaaggtggagtgccctggttataataaataatagtacccgttc

SEQ ID NO: 213 - DNA, 4131 bp, Rattus norvegicus
ctcggagaaagacaggccggccatcaggaaaacaaacaagcctcagcaacatctaaacccttgaaaggatcctgagagaggggggaaagggaaaacagcagccaccagcccaaccacttgtgtcttctgcccctccccacctatcttgcccaccccaccagcccacgctgcttgggacttgaaatctgtggccgaaggaccgtcaccacataacttcaaaaataatcaaccaccctccctacccaaacccacccaatctcactcatccagcatttcctttttggagtccactcagaatttttttcaacgaccccctctccctaatggagttgggtggggggaaaatgaaaactgagttggtctttacttttttaagagactttttgatccaatgaggccccacaagtaactgagtttgggtcctggttggttgttttattttttttcctccaaaattttacccctcccccctgagcccgaggtgctgacgtcgcaaaaaaattggataaagccaccatcatgggttcaggacccatagaccccaaagaacttctcaagggcctagatagcttccttactcgggatggagaagtgaagagtgtggatggaattgccaagatcttcagtctaatgaaggaggcacgaaagatggtgagtcgatgcacgtacttgaatattatcctgcagacccgggcgccggaggtgctagtcaagtttattgacgtcggcggctacaagcttctgaacagttggttaacgtattcaaagacgaccaacaacattcctctcctacagcagattctgctgactctgcagcacctcccactgactgtggaccacctcaagcagaacaacacagcgaagctagtgaagcagctcagcaagtcaagcgaggacgaagagctccggaaattggcatcagtccttgtcagtgactggatggctgtcatccgctcccagagtagcacccagcctgcagagaaagataagaagaaaaggaaggaagaggggaaaagtcgaaccacgcttcctgagcggcctttgactgaagtgaaggctgaaacccgggctgaggaagccccagagaagaagaaggagaagcccaagtcacttagaactacggcacccagtcatgccaagttccgttctactggactggagctggacaccccatctttggtgcctgtgaagaagaactccagcactgtggttgtgtcagacaagtacaacctgaagcccatccccctcaagcggcagagtgccacagctgctccaggcgatgctgccccgcctgcagagaagaagtacaagcccctcaacacaacccccaataccaccaaagaaattaaagtgaagatcatccccccacagcccatggagggcctcggttttctggatgctctcaattccgcccctgtcccaggcatcaaaattaagaagaagaagaaggttctatcacctactgctgccaagcccagcccttttgaagggaaaacaagcactgagccaagcacagccaaaccttcctccccagagcctgcagcccccgctgagcccatggacacagaccgtcctggcacccctgtccccgctgtggaagtcccggagctcatggatgcagcctcttcggagccaggagctctggatgcaaagcctgtggaaagccctggagatcccaaccagctgactcgaaagggcagaaagagaaaaactgtgacgtggcctgaggagggcaagctgagggagtatttctacttcgaactggatgaaactgagcgagtgaatgtgaacaagatcaaggactttggggaggctgctaagcgtgagatactgtcggaccgacatgcttttgagacagcccggcgactaagccatgacaatatggaggagaaagtgccctgggtatgtcccaggcctctggttctgccctcacctcttgtcatccctggaagcaacagccaggagcgatacatccaggctgagcgggagaagggcatccttcaggagctcttcctgaacaaggagagtcctcacgagcctgatcctgagccgtatgaacccattcctcccaaactcatccccttggatgaggagtgcgccatggatgagactccgtatgttgagaccctggagcctggagggtctggtggctcacctgatggagcaggaggctccaagctgcctccagttctggccaatcttatggggagcatgggagcagggaagagcccccagggccctggaggcggtggcatcaatgttcaggagatcctcacttccataatgggcagtccaaacaaccacccttcagaggagctgctgaaacagccagactactcagacaagctgaagcagatgctggtgccacatgggctcctaggtcctggtcctgtagccaatggcttcccaccaggaggccctgggggccccaagggtatgcagcatttcccccctggtcctggagggcccatgccaggtccccatggaggccctggtggaccagtgggtccacgtctcctgggtcccccaccaccttctcggggaggtgatccattctgggatggcccaggtgaccccatgcgaggtggcccaatgcgtgggggtccaggacctggtcctggaccataccacagaggccgagggggtcgtggaggaaatgaaccgccaccaccccctccattccgaggagccagaggaggtcgttctggaggaggccccccaaatggccgagggggtcctggtggaggtggcatggttggaggtggtgggcaccgcccccatgaaggccctggagggagcatgggcagtggacatcggtctcatgagggccctggagggagcatgggcagtggacatcggtctcatgaaggccctggacacgggggaccccatggccaccggccacatgacgtccctagccatcgaggccacgaccatcgagggccaccacctcatgaacaccgcggtcatgatggccatgggggaggcggccaccgagggcatgatggaggccacagtcacggaggagacatgtcaaaccgccctgtctgccgacacttcatgatgaagggcaactgccgctatgagaacaactgtgccttctaccacccaggggtcaacgggcccccactgccctaggcctgcctgccctacccgcacccctgtggactgcagctttgctccttccacttggttatggcttctgtgaggcccactttccttttccccagctgatgaggagccggccccctcagttcccacctggttgggtttctgggggtttctgattcctggtgtgcattgatgtacatattccctccagtctggagcggagaggagagagactggactgctgagacggctggcttcactttgtgaggagatttgccctgtgccccaaaccccttccagtattagccccgatgcctgagaacctgaagccggccaccctggagacctctgctctccacatgcacacggaactgagttggtcagctgcacttaggaaaccgtccaagctaagctcattatcttcacagggtgagggggtggtgaggggtaccatatatcccactgcactgagggctcaagctggctgaagctgagttctggaactaccccccacttgtgccccacatgggccagtcactgttgagtcctttctcaagaaggactgcaactgttacttcccaggtcatcgtgggtctgctaggttcagtgatggcacattcatatctgtgtccagtggaagttgtatctggcagaggggtggcctgtagtgttgggccactcttgcctacagccattttcgagactccgtgaggccagctttcattaactttagccgggtataccgggcctgacgcactacatgcactgcctttgggagtgggctggctccttaccccgtaaggagccctgtcagtgaggcttcctgggtagactcagcaggaggggcccttcccagtcctctcctccccctgtcttggcatcagttgttttctatgaaaacagtgggttggttttgtgcagggtcttgggttagaaccaatggatttgaggagttttttcttttggttttgtatattttgtacattaataataaacagtggaaagagaagcagctcattt

SEQ ID NO: 214 - DNA, 2540 bp, Rattus norvegicus
ccgcggcccactacagcagtcgcccgccgtcagcctcccgcgctcgtctctcgtcactgctgctcggcgtccattgctgcctctccccgcagtcgccgacgtcgcttccccgcgcgctcccacaaccgccgccccgccggtcagtgaagccggtgagccattccccgcgccggcccccagaggcgggcatccagccggaccccgagtgtggccctctcctgctgtggccgtccgcgccttctcgaccgcttatccagcatgaaaaccaagttctgcaccgggggcgaggccgagccgtccccgcttgggctgctgctgagctgcggtggcagcgctgccccgacgcccggcgtagggcagcagcgcgatgccgcaggcgagctggagtccaagcagcttggtggccggtcccaacctctcgcgctgccgccgccaccaccgccgcccctgccgctgcccccgccgccatcaccgccgctagcggacgaacaacccgagccccggacgcggcgcagggcctacctgtggtgcaaggaattcctgcccggagcctggaggggccttcgcgaggaccagttccacatcagtgtcatcaggggtggtctcagtaacatgctgttccagtgttccttgccagactccatagccagtgttggtgatgaacctcggaaagtgctcttgcgactgtatggggcaatcttaaagatgggggctgaagcaatggttctggagagtgttatgtttgccattcttgcagagaggtcacttgggccaaaactctatggcatctttccgcaaggccgactggagcagtttatcccgagccggcgattggacactgaagaattatgtttaccagatatttctgcagaaatagctgaaaaaatggccacatttcatggtatgaaaatgccattcaataaggaaccaaaatggctttttggaacaatggaaaaatacctgaatcaagtactaagacttaaattcagcagggaggccagagttcaacaactgcacaagttcctctcttacaatctgcctctcgagcttgagaacctgaggtcattgctgcagtatactagatccccagttgtgttttgtcataatgactgtcaagaaggtaatatcttattgttggaaggccaagagaattctgaaaagcagaagttgatgctcattgactttgaatacagcagttacaattacaggggatttgacattggaaatcatttctgtgaatggatgtatgattatacctatgaaaagtatcctttcttcagagcaaacattcagaagtatcctacccgaaaacaacagctccattttatttcaagttacttgactacattccaaaatgattttgaaagcctcagcagtgaagagcagtctgctacaaaagaagacatgttgcttgaagtcaacagatttgcccttgcctctcatttcctctggggactttggtccattgtacaggccaagatctcatccattgaatttgggtacatggaatatgcccaagccaggttcgatgcctactttgaccagaagaggaagcttggtgtgtgaatggatggctccactcttcaccactggactgcaggaggtggctgcaccaggccctcagtggagcgctgctgtgaccactgccctgggcagaaggcctggacgtctcactactgagcaccgatgtgtatgatactacagactatattaaagtggagtaacatttctttcatctttgtttacactctcactaggactctgaaccatgattggaagcagaaatatagtgtgatagtgcaatagctcagaccccgcctaagcgggaggcctttcagctacatggctacagcttcagccacttaggccccagccagacagagcagtgctgtgtgggtactgagtgctgacttaggatattaatgtgctgcaacacgttcatgaccaggctttgaaggtgacagtctgacaatgtgttggagacactctgaagggcaagtgaacagacatactgtgaaatggctcgacaggaggagcctgaattgtggggtctgtggaggcagccagctgtttctgtacagggtacacttgactatgggtatgcatctgcaggcagtagctgcagccctcctgtgcctgtgtacacatgactacaggggccagtgtcactgactggccataactgcagtgtctcctaactgggtgtgctttatgcttcagcttcccggggaggagcagtggagccagcttcctcaccccttcttgccttctctctgcctgacctggaacttgggctttcgcccattgccctctgaagctgcttcccatctgatgtcactgggagacagcagctgtatgtgtggggtattggggtgcaggtagattagagctgtgaaatccatgtacattaatacccaatgggataaacctagaatttttttttttttactctgaactctgaattgttttgtgcacatatttctgctaccaccgaaactgtattatacagataaataaacaacttgaaacttaaaaaaaaa

SEQ ID NO: 215 - DNA, 614 bp, Rattus rattus
aagactttataattttattactttgggtttttaacattctacataataatgcctgataactcttttctgtttgtctctctaattgcaagccagaaactactcaaagctgagactgctttcctggccccggaaggcacaggggcgcagctgcttcttcagagttttgccgccatgaagttaatgtgtggcttcacaagggggaacagcggcaggccgcgcttgaattcagtcatgttatgaatcacctcaggttgtggcaagggtggcgcttcggaaaggtttatatcattctgagaggggaactctccaaccacaggacaagaatccatttccctggcaagaacgtggacggatactttatgtctccttggtgcgtccacagccaacatttccttgtagaatttgatgatatcgtccttgctgagtgtctttaaatatgcaacctctatgttatctctgtcataattgtactgctgggagatgatctccccccagtacttcgcgcactctgcagagagtttctttggtttgtcgagtcggcgaatcgctaacgcctgaatgtgtttttggaaagcctcctctgtcatgtcctctatggccttttccatcctcgt

SEQ ID NO: 216 - DNA, 471 bp, Rattus norvegicus
tacagggatgccttgctgaccagcaccatcaactgtgttaccagttttatttctggatttgccattttctccatccttggttacatggcccatgaacataaagtcaagattgaggatgtcgccactgaaggagctggccttgtatttgtcctgtatccagaagccatttctactctgtcgggatccacgttctgggctgtcctgttcttcctgatgctcctggctctggggctagatagctcaatgggaggcatggaggcagtcatcaccggactggctgatgacttccaggtcctgaagcgacaccgaaaactcttcacatgtgctgtcaccctcggtacctttcttctggccatgttttgcataacgaagggagggatttacgtcctcactctgctggacaccttcgcggcaggcacgtccattctctttgccgtgctcatggaggccattggagtttcctggttttat

SEQ ID NO: 217 - DNA, 187 bp, Rattus norvegicus
  misc_feature (29)..(29): n is a, c, g, or t
  misc_feature (81)..(82): n is a, c, g, or t
  misc_feature (180)..(180): n is a, c, g, or t
aatctgttccctcccacccagcccacttncccccaaccctggaaacagaccaacaacccaaactcaatttccccaaaagcnnaaaattgggagacaattttacatggactttggaaaacatttttttcctttgcattcatctctcaaacttagtttttatctttgaccaactgaacgtgnccaaaaa

SEQ ID NO: 218 - DNA, 800 bp, Rattus norvegicus
tccaagggacaaaagaaaagaaaagaaaaaaatactaaaaaacaaacaaacaaaaaaaaaaaacaaaagaaaaaaatcacagaacagatggggtctgagactggatcttctatcattccaataccaaatccgacttgaacaagactggacttacaaaatgccaaggggtgactggaagtttgtggatatcagggtatacattaaatcagtgacctggggggagggaagaccagagttcccttgaattgtgcttcaatgatgcaatatacatggaaagaccaccttgtatgctctttgccttctaaaaagccattatgacgtcagaggaagaggaagcaattcaggtacagaacgtgttctaatagcctaaacgatggtgcttggtgagtcgtggttctaaaggtaccaaacgggggagccaaagttctccaactgctgcatactttgacaaggaaaatctatttttgtcttccgatctacatttatgacctaagtcaggtaaataagcctggtttatttctgtaacattttttatgcagacagtctgttatgcactgtggtttcagatgtgcaataatttgtacaatggtttattcccaagtatgcctttaagcagaacaaatgtgtttttctatatagttgccttgccttaataaatatgtaatataaatttaagcaaacttctattttgtatatttgtaaactacaaagtaaaaaaaaaatgaacattttgtggagtttgtattttgcatactcaaggtgagaaataagttttaaataaacctataatattttatctg

SEQ ID NO: 219 - DNA, 561 bp, Rattus rattus
aaatcctgatactttatttcttatatcctagctatcaaatcccatatgaattttcagcattaaatagtgacacatatcaagtttcagagatttattcatcagtgtaataaactcaaaaaaaaatcaacatgatttcatgcattcggagacatagttcctgcttaagtggaaaattgtgcggatggcttctgaaagaccttcattgtaagcagctttgcagtgaacttcacagtttagaagtctgggccttcttttttcagtttgctgtagtccacgttcacagaatagaacttatattgttcattgggacccagtttgttccaaggctctgggttattcttcctgtcccagctgacatctggattgaacaatgccaagcgcatcacatacagtgctgctccagtaccccctgctccaataaacacgaagagagggatcaagctgggatgtttcttggcttgcccgaggatctggcggagcatgtttgcggcacaggcctacctacaccgagagagaagattaggacacacactaaaccgcttctgcaacctgcctcgtgcc

SEQ ID NO: 220 - DNA, 303 bp, Rattus norvegicus
ctggtgaagccaccctactcttacatcgcgctcatcaccatggccatcctgcagagcccgcagaagaagctgaccctgagtggcatctgcgagttcatcagcaaccgcttcccgtactaccgggagaagttccccgcctggcagaacagcatccgccacaacctgtcgctcaacgactgcttcgtcaagatcccccgcgagccgggcaacccgggcaagggtaactactggaccctggacccccagtccgaggacatgttcgacaacggcagcttcctgcggcgccggaagcgcttcaagcgc

SEQ ID NO: 221 - DNA, 679 bp, Rattus rattus
caagactgctttattagacaacacagtgacatgaatgccgctggcagccatcatggtgggacagtcacactgacattcccatgctctcctcctcctggcagaagcacggctcacgggtctcaaggagacagacgtcacatcttcctctcagcgcccatttgtggcagagtaagtcctttgtgactgtcattatggaactgtgttttctgtaactgctccatgattatcatagttttgcagtggctggttttcctattggcttcttacatccgagcatttcttctaacttgcttgtggcaggcccgttgacataatacacatatttactgtctaccttattcttttctaccaccccgagtctcacgaaggctgctaaggcattcttctgaagttcagaggacagcgcgtcgtaacactgacaggcatcttgatccagaagctggcgggtgaacttcctggctgtgaccaagtactccttctcactgaagtagtcctcttcatgcaagaggcatttggaaagtatctgatacgattccacaaaaggtttaaagagtcctgtgaggaactgtaatacagcattccctttgtctgtgaggatgatgtccttcccagtcatctgcataacctcagttttacacagcaagtaacagccttcctcaaagtccctgagtgtgtttcc

SEQ ID NO: 222 - DNA, 2632 bp, Rattus norvegicus
ctgcagcagggctcatggcagatacccagtacatcctgcccaatgacatcggtgtgtctagcctggactgccgggaggcattccgcctgctgtcacccacagagcgcctctatgcccatcacctgtctagagccgcttggtatggaggcctggctgtgctgctccagacatctcctgaagccccctacatctatgccctgcttagccgcctcttccgtgcccaggaccctgaccagctacgccaacatgccctggctgagggcctgactgaagaagagtatcaggcattcctggtctacgctgcaggggtctactccaacatgggcaactataagtccttcggtgacaccaagtttgtccctaacctgcccaaggaaaagctggagcgtgtgatccttgggagtaaggctgcccaacagcatccagaagaagtcaggagcctttggcagacctgtggggagcttatgttctccctggaaccaaggcttcgacatcttgggctggggaaggagggagtcaccacctatttctctggggattgtgccatggaagatgccaagctggcccaggacttcctggactctcagaacctcagtgcatacaacacccggctcttcaaggtggtcggccaggaagggaagtaccactatgaggtgcgactggcttcagtactcaacacagaacctgctctcgactctgagttgacttccaagctgaagagctacgagttccaggggaatcatttccaggtcacccgtggggactatgcccccatcctccagaaggtggtagaacacttggagaaagctaaggcttatgcagccaatagccaccaggagcaaatgctggcccagtatgtggagagcttcacccagggttccattgaggcccataagaggggctcccgcttctggattcaggacaaaggtcccattgtagagagttacattggcttcattgagagctaccgtgacccctttggctcccgaggagaatttgaaggcttcgtggccatggtaaacaaagacatgagtgcaaagttcgagcggctggttgcaagtgctgagcagctgctgaaggagctgccttggcctcctgcctttgagaaggacaagttcctcacccctgacttcacttccctggatgtccttacctttgccggctctggcatccctgcaggcatcaacatccccaactatgatgacctgagacagacagagggctttaagaatgtgtctctggggaatgtgctggctgtggcctatgccacaaagcgggagaaactcaccttcatggaggaagaagacaaggacctgtacatccgctggaaggggccgtcctttgatgtgcaggtggggttacatgagctgttgggccatggcagcggcaagctctttgtacaggatgagaaaggtgctttcaactttgaccaggagacagtgatcaacccagagactggggagcagatccagagctggtaccggagtggagagacatgggatagcaaatttagcaccattgcctccagctacgaagagtgccgggctgagagcgtgggcctctacctctgtctcaacccccaagtacttcagatctttggctttgagggaactgacgcagaagatgtcatctatgtgaactggctcaacatggtccgggctgggctgttggctttggagttctacaccccagagacggccaactggcgacaggcccacatgcaggcccggtttgtgatcctgagggttttgctggaagctggcgaaggactcgttaccgtcacccccaccacaggctctgatgggcgcccagatgctcgtgtccacctggaccgcagcaagatccggtcagtgggcaaacctgctttggagcggttcctccggagactgcaggtgctgaagtccacaggggatgtggttgcagggcgcgccctgtacgagggctatgcggcggtcactgacgcacccccagagtgcttcctcactctaagggacacggtattgctgcgcaaggaatcccggaagcttattgtccagcccaacactcgcctggaaggctcagaagtgcaacttgtagagtatgaggcctcagcggctggtctcatccgatccttctgtgaacggtttccggaggatgggcctgagttggaggaggttcttacccagctggccacagcagatgctcaattctggagggatcaggtccaggaggccccatctggccaggcttgagaagatctgtgtggcatctcccctttcatcaaaccagggctgtctgtggccctgaattgtgtttaggaggtgggggaagggcaggagctcggactttggtgctacctcagctgagggtggtgatgctaaccccttccatttgtcagcactttccagtttaccattatgtcctcatttcctggatctgcactgccatctgtggtgggagctcaacagggtgcctagtctggttttccaaatgggaaggtggcagttctgagaagtaactgttctagatccagcaggtggcatgtgacagagccagggctcaaagcattctcaccaaatccagtgctcttcgtgtattaccttttatagccagaaaaataaatatgacaaccaccaaaaaaaaaaaaaaaaaa

SEQ ID NO: 223 - DNA, 2337 bp, Rattus norvegicus
acagctgctctgcggagcccgcacccgccgagctcctcctacatgcagctggcgagcggcaccatgcagcgggccatgctcctcggcctcctgggcgcagcagctctggctgctgtcatctcagctccagtggataacagggatcacaatgaagaaatggtgactcgctgcattattgaagtcctctcaaatgccctatccaagtccagtgctccaaccatcacccctgagtgccggcaagtcctgaggaagagtggaaaagaggtcaaaggtgaagagaaaggtgaaaatgagaactcgaagtttgaagtacggttgctaagagacccatctgatgcctcagtaggccgctgggcctccagtagggaggaaacaggggctccagtagaagactctccaggtcaggcgaaggtagacaatgaggagtggacaggaggaggaggacacagtcgagaggcagtagatgaccaggagagcctccatccctccaaccaacaagtgtccaaagaagcaaagatacgccattcggaggaaaggggcggaaaagaggaggaggaggaagaaggcaagatttatccaaagggagagcataggggagatgctggtgaggagaagaaacacactgaagaatctggagagaaacacaacgccttctccaacaaaagaagcgaagcctcagctaagaaaaaagaggagtcagtggccagagcagaggcacacttcgtggagctggagaagacacacagcagggagcagagcagccaggagagtggagaggagacgaggaggcaggagaaaccacaggagcttcccgaccaggaccagagcgaggaagaatccgaggaaggcgaggaaggcgaggaaggcgcaacctcagaagtaaccaaacgcaggcccaggcaccaccactggagaagccagtccaacaagccctcttacgaagggcgtcgtcctctgtctgaggaaaggaaacatgctgctggggagtccaaggatgcaaatgtggccacagccaatttaggggaaaaaaggggccaccacctagctcactaccgggcttcagaggaagaacctgactatggggaagaattgagaagctatccgggcttccaggctccccagggactgcagtaccggggcagaggaagtgaagaggtcagagccccaagccctcggagtgaggagagccaggaaaaggagtacaagagaaaccaccccgactctgaactggaaagcacagcaaacagacacagtgaagaaactgaggaagagaggagctacgagggggcaaagggacgacaacacagaggcagggggcgggagccaggagcttatcctgctcttgacagcagacaagaaaaaaggctcctggatgaagggcatgaccctgttcatgaaagcccagtagatacggcaaaaaggtatccacaaagcaaatggcaaggacaaggagaaaactacctcaactatgacgaggaaggggaccagggaagatggtggcagcaggaagagcagctagaaccggaagaaagcagggaggaagtgagctttccagacagacaatacgcgccctaccccaccactgaaaagaggaagaggctaggggcgctgttcaacccgtactttgaccctctccagtggaagaatagcgactttgagaaaaaaggcaacccagatgacagtttccttgatgatgacggcgaagacggaaatggggtgacaatgactgagaagaatttcttcccagagtacaactatgactggtgggagaaaaggcccttctcggaggatgtgaattggggatatgagaagagaagctttgccaaggcccctcacttggacttgaaaaggcaatacgacgatggagtggctgaactggaccagctccttcactacaggaagaaggcagccgaatttcccgacttctacgattcagaggagcagatggggcctcaccaggaggcagaagatgaaaaggacagggctgaccagagagttctgaccgaggaagagaaaaaggaactggagaacttggcggccatggatctggaactgcagaagatagcggaaaagttcagccagcggggctgacagtcggagagacgagccattcgctgaaagacagcattgattcacccaaaggcagaaagcagaatttactatttattaaatgtttgatgcagttggaaatatcactaatctttgccagaatgctaatgctatgcgactagcgtgacttgtagcatattcttcctgcaaaatagatgttccacatgtctgtgacaatgaccgtgttactgtctttgaaacacaaacaataaaagatttacctgaaac

SEQ ID NO: 224 - DNA, 5028 bp, Rattus norvegicus
gcctggcaggcgggagaacgctccggagttgtggccgtgggcaccgggctcgcggcaagaggagcggagagcgggcatctcctgagcgccgtcatggctgcttaggctgcgcctgccagcggaccgacggtgtcgcccgaatccggctcggataggtctggttggagtctgtgcctgcttgcttggcgtgtggttgttcctgcttgattggcacggtgccattggcttcgtatttgggaatcggaggagttaatcttgtctcttctcacaggttcgagtcctcagaccttctgcaggactccatccatatctgcctcgcagctgactctcctgctcacacagaagacggccatcctagatccccagctattgtgctgaccatccccttcctgctccggatctcgcctggctgctaggctgtggtgctgccttttcagagtcaggctgtagcgactccccgccttcgtcccggctgggcttaggtggaacagtggttcatctcatctcatcagcacttctgaagaagaaagtgtgagaagcagaggccatggctccttttcgctgtcaaaaatgcggcaagtccttcctcaccctggagaagttcaccatccacaattattcccacaccagggagcgcccattcaagtgctccaagactgagtgtggcaaagccttcgtctccaagtataagctgatgagacacatggctacgcactctccccagaagacgcaccagtgcactcattgtgaaaagactttcaaccggaaggatcatctgaagaatcacctccagacccacgatcccaacaagatgatctacgcctgcgaagattgtggcaagaaataccacaccatgctgggctacaagaggcacatggccctgcattcggccagcagcggcgatctcacctgcggcgtctgcaccctggagctggggagcaccgaggtcctgctggaccacctcaagtctcacgcggaagaaaaggcccaccacgcgcccagggagaagaaacaccagtgcgaccactgcgagagatgcttctacacccggaaggatgtgcgtcgccacctggtggtccacacaggatgcaaggacttcctgtgtcagttctgcgcccagagatttgggcgcaaagaccacctcactcgtcacaccaagaagacccactcccaggagctgatgcaagagagcctgcaagcaggagaataccagggcggttaccaacccattgcgcctccgttccagatcaaggctgatcccatgcctcctttccagttagaaatgccccccgagagcgggcttgatgggggcttgcctcctgagattcatggtctagtgcttgcttccccagaggaggttccccagcctatgctgtctatgccgccaatgcagccaatgccagagcagcctttcactctgcaccctggggtagttccctcctctcctcccccgatcattcttcaggagcataagtacagcccagttcctacctcttttgccccgttcgtaagcatgccgatgaaagcagatctcaagggcttttgcaacatgggtctctttgaggaatttcctctgcaagagtgtcagtcgcctgtcaagttcagtcagtgctttgagatggctaaggaagggtttgggaaagtcaccctgcccaaagagctgctggtagatgctgtaaatatagccattcctggctctctggagatttcctctctcttggggttctggcagctgccccctcctcctccccagaatggcttcatgaatggcaccatccctgtgggggccggggagccgctgccccataggataacttgtctggcacagcagcagccaccacctctgctacctccgccgccgccgctgccgctgccagagccgctgccacagccacagctgccgccacagtttcagttgcagctccagccccagccccagatgcagccccagatgcagctgcagcctctacagctgcagctgccccagctgctgccccagctgcagcccgagcctgagccagagccagagccagaggaagaagaggaagaagaagaagagatagaagaagaagaagagatcgaagaagaagaagaagccgaaccagaagcagaagaagaagaggaggcagaagacgaagaggaggcagaggaagaggaagaagagccacagccagaagaagcccaaatagcaatgagcgctgtgaatatgggccagcccccgctacccccgacccctcatgttttcacagctggcaccaacactgctatcctgccccatttccaccacgcgttcagataaattggttttttaagagggtgcttctcttctggaagatgtttcaaacaccagttccagttccagacatcagttacagtttgaagagaagcgttggaaaaacaggaatggggtttctagcttattgccatgagtagattgagaaaaagaactctcttaactgcatgcactgtgccaatacatatatatatatatatatatatatatatatgtatatatatatatatatatatcatccttagtattcatgctttgtaccaaacttagtgagtgcgggcgttctccgtaatcgaactgcaagtagtatcatattattaccctgatattgttagtctcatattattagccttgtattattctcatataatcaaaaccaagatccaaaacatgagctgctaatttgtaaatatcgtgttgagtgttagccgtcgtagtgatgttagctgcgtagttgcgtgttagcactgcctaggaagggcacgagggccaagttgggcttctcccacttggaagatgttttgaagagaagggggtgatctccgtagggcgtccgtaactaggccgtgtgttcttttcagggacccgtctaccttcaggattggatgtagtttagtcgctcttcttcttagctcgctttgtagtttgtccttctggtagcctactgtgtgtgtctgtgtgtagctttataggaaagttccgtgtgaagctgtcggtgtcttcgttttcaaaagtgaattttaaatgtatttttcaatatttttcatgtgatgttgtaccaatgtgaattatgacttcgtttatcttaaagacaaaactggttgtcagtcatatctgacaggaagaaagaaatccctgtgggtaggcaagtcaagtggccaactaatgagaagaagcatcaatcgaaagtgttggctgactgggacactcatgattctcacaggactttgagaaacgtactggaattaaaaaaaaaaaagcttaagtacattagataagaattttctttgcctagcttaacctactacttaagcctcttaagttctgaagtattgtgatcaaccaataggaaaatgtatctgtagttgatgaatttcagtccttgttactttgtatcccaagaggtttgtgttttgggaatgtaaccgtacttgtaatctcagttggtatcttgctaatcgatttgaaagtgtaaaacctaacccttgaagactctgtatttccttttttgagactgtatttcccagcatgtataccctaacctttggagactctgtattctgtttttgagactttccccccgccccccagcatatgtaccccgacccttgaagactgtatttcgtttttgagagcgtatttcccagcatatatacactaacccttgaagactctgtatttccttttttgagactgtatttcccagcatatatacactaacccttgaagactctgtatttccttttttgagactgtatttcccagcatatatacactaacctttgaagactctgtattctgtttttgagacccccccccagcatatgtaccctaacccttgaagactgtatttcgtttttgagaacgtatttcccagcatatatacactaacctttggaagactctgtatttcatttttgagactgtgtttcttagtatacataccctaacctttgaaagactccatttttgagacttccccccccccagcatttgtgccctaacccttggaggctttgtattttttttttgagacttttccgccagcatatatacactaacccttgaagactctgtatttcatttttgagacttttttccccagcatatataccgtaacccttgaagactctgtattccgtttttgagatttttttccctcagcatatataccccaacctttgaagactctgtatttcatttttgagactttttcccagcatatataccctaacctttgaagactctgtattccatttttgagattttttccctcagcatatataccctaacctttgaagactctgtatttcgtttttgagattttttcccccagcatataaacactaacctttgaagactctgtatttcatttttgagacttttttcccagcatatataccctaacccttgaagactctgtaatctgtttttttttttttttgagactttttcccccagcatatatacactaacctttgaagactctgtattccattttttgagacttttttccccagcatatataccctaacctttgaagactctgtatttcatttttgagactttttccccagcatatataccctaacctttgaagactctgtattccgtttttgagaccccccccccggcatgaataccctaatctttgaagactctggtatttcatttttgagatttttttcccctcagcatatatacactaacctttgtagactctgtattccgtttttgagactttccccccccagcatgtataccctaacctttgaagactctgtatttccagcatttgtaccctacccttgaagactctgtatttcccagcatttgtaccctaacccttgaagaccctgtatttcgtttgtaagacttttccccagcatatatatcctacatataataaacgctaagcatctagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 225 - DNA, 2488 bp, Rattus norvegicus
gcgaaagttggggtagtgtgcgagaaggattgcagagcgcacgcggaaccagactgcgactgggtcctgggtcgctggtcccggccacggggagcgggagccggccggagatgccctgtatccaagctcaatatggaacaccagcaaccagcccaggaccgcgtgaccacctgacaggtgaccccctggcccttgagttcagcaagcccaccatggacctggccagccccgagacggcgcccaccgcacctgccaccctgcccagtttcagcaccttcatggacggcggatacaccggagagtttgacaccttcctataccagctgccggggacagcccagccgtgctcctcggcctcctccacatcttcttcctcgtcctcggccacctctcccgcgtcggcttcctttaagtttgaggactttcaggtgtatggctgctaccctggcaccctgagcggcccattagacgagaccctgtcctccagtggctctgattactatggaagcccctgctcagccccgtcaccacctacacccaacttccagccatcccagctctccccttgggatggttcatttggccacttctcccccagccagacttatgaaggccttcgggtatggactgagcagttgcccaaggcttccgggcctccgccacctccaaccttcttctccttcagtcctcccaccggtcccagccccagcctggcccagagttccctgaagttgttcccagcaccagccacccaccagctaggggagggggagagctattccgtgccagccgctttcccgggcttggcacccacctctccgaactgtgacacttccggcattctggacgcacccgtaacctccaccaaggcccgcagtgggtcttcagggggcagtgagggccgctgtgctgtctgtggagacaacgcttcgtgccagcattatggggtccgcacctgtgagggctgcaaaggcttcttcaagcgcacagtacagaaaagtgccaagtacatctgcctggcaaacaaggactgccctgtggacaagaggcggcggaaccgctgccagttctgtcgcttccagaagtgcctggctgtgggcatggtgaaggaagttgtccggacagacagcctaaaggggcggcggggccggctaccttcaaaacccaagcagcccccagatgcctcccctaccaatctcctcacgtccctcattcgagcacatttggactccgggcctaacactgccaagttggactattccaagttccaggaactggtgctgccccgctttggaaaggaagatgccggtgacgtgcagcaattttatgacttgctctctggctccctggacgtcatccggaagtgggcggaaaagatcccgggcttcattgagctttccccaggagaccaagacctgttgctagagtccgcctttctggagctctttatcctccgcctggcctaccgatctaagcccggtgaggggaagctcatcttctgctcaggcctggtgctacaccggctgcagtgtgcccgcggctttggtgactggatagacaacattctagccttctcacggtccctgcacagcttgggtgttgatgttcctgcctttgcctgcctgtctgctctggtcctcatcactgatcgacatggcctccaggaccctcggcgggtggaggagctgcagaaccgcattgctagctgtctgaaggaacacatggccgccgtggcaggagacccacagccggccagctgcctgtcacgtctgctgggcaaactgcctgagctccggactctgtgcacccaaggcctacagcgcatcttttgcctcaagctggaggacttggtgccccctccacctatcgtggacaagatctttatggacaccttgtctttctgaccctgccccgaacacgcgtgcacactcacgtgcatgttcttcttgtcacccacgtgcctttaagcccatagcccacggacccccagaccaccccaccccccagcctgttttttgagctaagactgatgtatctcctcattccagaagatggacagagagagagagagagctcaagacctgggggggagggtgtgtattcacgggggtgaccccactatttctcttatccctcccagctcagacctggccttccgcgtgtttttgtaagataaaccatttttaacacataccactctgctgtatataagctgacgctgctgtaaatacagaaaggaagaggtcggggtgggggtttgagaggaagggtgggccccccaaccccgccagctgggcaagcctctcgagcctccaacttgagatctcttccgctctccttccatgtgtacatagctgtcactcaagaaggtgattgacagattctgatttatatttgtgtatttttttcctggatttataggatgtgactttttctgattaatatatttaatatattaaataaaaactagacatgtagctgaaaaaaa

SEQ ID NO: 226 - DNA, 4986 bp, Rattus norvegicus
agtgagcgctggctcatcgccgcccagcctctcccagggagcctcctagctctagtaaagcaacccagagccaggagcagtgtgcagggtggaaaggtctagcctagctggtgtgtttctgatcttgcttcttttctctcagcccttcctacttgtgcgagccatgaagcaaagaggttggactctgcagtgtactgctttcaccctcttttgcgtttggtgtgcactgaacagtgtaaaagcgaagaggcagtttgtcaatgaatgggcggcggagatacatggagggccagaagctgcttctgccattgccgaagagctgggctatgacctcttgggtcagattggatcacttgaaaatcactatttattcaaacacaaaaatcatcctcgaagatcccgaagaagtgctcttcatatcactaagaggttatctgatgatgatcgtgtgatatgggcggaacaacaatatgaaaaagagagaagaaaacgttcagttccaagagactcagcattgaatctcttcaatgatccaatgtggaatcagcagtggtacttgcaagacaccagaatgactgcatctctgcccaagctggacttgcatgtaatacctgtttggcaaaagggtattactggcaaaggagttgttattactgtactggacgatggcttggagtggaatcacacagatatttatgccaattatgacccagaggctagctatgattttaatgataatgatcatgatccatttccccgatatgatcccacaaatgaaaacaaacatggaacaagatgtgcaggagaaattgccatgcaagcaaataatcacaaatgtggagttggagttgcatataattccaaagttggaggcataagaatgctggatggcattgtaactgatgccattgaggctagttcaattggattcaaccctggccatgtggatatttacagtgcaagctggggccctaatgatgatggaaaaactgtggaggggcctggcagactagcccagaaggcatttgaatacggtgtcaaacaggggagacaaggaaaaggctccatttttgtctgggcttcagggaatgggggtcgtcaaggagataactgtgactgtgatggctacacagacagcatttacaccatctctatcagcagtgcctcccagcagggcctgtcaccctggtatgcagagaagtgttcctccacactggccacctcctacagcagtggtgattacacagaccaacgaataaccactagtgcggacctgcacaatgactgcacagagacccacacaggcacctcagcttctgcacctctggctgctggcatctttgctctagccttggaagcaaacccaaatctcacctggcgagatatgcagcatctggttgtctggacctctgagtatgacccattggccaataacccaggttggaaaaagaatggagcgggcttgatggtgaacagccgatttggatttggcttgctaaatgccaaagctctggtggatttggctgatcctagaacttggagaaacgtgcctgagaagaaagaatgtatcataaaagacaacaactttgagcctagagccctgaaagctaatggagaagtgattgttgaaatccctacaagagcttgtgaaggacaagaaaatgctatcaattccctggaacatgtgcaatttgaagcaacaatcgcatattctcgtagaggagaccttcatgtcacacttacctctgctgctggaaccagcaccgtactgttggctgaaagggaaagggatacatcccccaatggctttaagaattgggacttcatgtctgttcatacatggggagagaatcctgtaggcacctggacattgaaagttacagacatgtctggaagaatgcaaaatgaaggaaggattgtgaactggaagttgattttgcatggcacatcttctcagccagaacacatgaagcagcctcgtgtatacacgtcctacaatactgtccagaatgacaggagaggagtggaaaagatggtgaatgttgtggaggagaagcccacacaaaacagcctgaatggcaatctcctggtacccaaaaactccagcagcagcagtgtggaagacagaagagatgagcaggtacaaggagctccttcaaaggccatgctacggctcctacaaagtgctttcagcaagaacacaccttcaaagcaatcatcaaagattccaagtgctaagctcagtgtcccttatgagggtctctatgaagccctggaaaagctcaacaagccctcccagcttgaagactctgaagacagtctgtatagcgactatgttgatgttttctataacacaaaaccttataagcatagagatgacaggctgctgcaagcactcatggacattctgaatgagaagaattaaaataagtgtatatggcctgagttagaaatccttatgtaccctccttttccttagatgttcctgggtctggagttgttgtatccctgcttcctgtgattcacataatgtccttcattgtaattttactttttcttctcaaactgtacttttggagtgagttccaaaatgaaagccaacttcataattggtctcagtgtttaagaatatgtcttccctgtctatacaagtgaagcaacttctttctaaagtcgctgttgggacacaaccctttgctgcagtagaacagctcctaaagcctccccatttcatatctcacaagaataggaaaagagtgggagatttagaaaagtaatcaacaatggtagtttgagggctacagcttatcttgtttcctatttttgcaatggggttctttgaattttgataacaaggaagcatttataaagtatctagtgagaaagttcacaactaggttcagatcataagtaacatgtattactaatgctgagactgataaactgaccattttggaggagctggaataaaatgctttatttaaattcagaaacagagcttaagatttttattagctagaatagttgctctcaattggtgtaccatgtagaggtctctgtgggtcgaaagttggctgtgacccttgctgtatgagacctggctttctatttccccctttgtgccttgtatgtttcttttttgtgtggcaaactcaaaattcaaagaaagaactaattcatgtgattttctcaaaacaaagttatacttcattttggcaaattcctagtcataattttgtttaataacaaggagtcactcaaaaatatagaaagccaatataataacagggaaaatgttcacaaagcagagaagcagcaagactccctttgcaagctgtattcctaggacagcttcttttggttctctatatgaatggtcatttctggacaccacaggtcttctgtagtctcagagaacagtattcaaattcttaacaaaatgcttccatgtttcaaatcaaaaacaggtagacaacacttaggtcttatttttattctctgtaagttatgaagaatatttcagaagtgtgaaagactgatgaaagtgtgaagtgtagatctcatataaaaccgattctcggacccatcttccatcacagcaacagctagctagagatagcaacttccaagtaaaatttaaagtcaagccttccctggtccatatatttttttgttttacaatagccagttaattggttactactcagcatccaagccatttattcctttttaattatcatctattagttgcagggagtcagatttcattttgacattctcatacaccacgtatttcatgatttgtacaatgtccatcccgcatcagcatctcttctgtctctccttgcttgtcctcttgctcttctaagtattcccacttccactttcaggactttttatctaactcagattccacatataagagaaaatgtgatgtttgtctttctatgcatgtaactttgcctactcatatactaagtgaatctatatcggtgtaaatacattaggaaaagtatttcctgcaattatttccaagcagtctttgccgttaataattgaatttgatatgagctagttaaattgttgcatttataagtaaaacagtgagtacttcggacccacaaaatacctctaaagtctcctttaatatgaacacttgatcttatctcacctggatgttcaaatgtactattcattaactagagatttccttctcttaatatgccaacatacactctagttaactctctgcctgtgttgtccaactgagtttctgtttgcaaatgtcctacacagtctacatccactgctaagacagctaatttgtctttgctttgagtgagattagtagcacaaattttcacctcctgtttcatcatttgcatttgtacataacaaagccctttccagagccttgcccttgatccctctgattttgaaggttttgcaatgtgtttactataaggtttaaataaaatgtttactattatagcacattacaactgaaaaggacttaagagttaaaacattaaatttcagctacttagaaaagacctaaagaataatatcagtaactgacaattaatatgtgattttaaaaaacgaaagagtgggaggtcaaccccaccctttctggtccttattctaacttatggagatttttcttcagcactttctaatatatatttcccctctaagaaccctaaccaattcatggctatagccaaatattcacttgggtaagctttaatatttagacaataccatgtttgaatgtttccaacctggagtatatattgtctacacataaaaagaatatttttgtcagcctttcttagtgcctatgtggaatttttgtgaaaatgttaaaaaaggataattatataatatttcccttggaatattaagctatattttctttacaagtatttgtaatgtaccaatgcttttaacaacagaattttaaaaagcataataaattatatt

SEQ ID NO: 227 - DNA, 533 bp, Rattus rattus
ccatagaaaacaattttaatgcaggtattacctcagatgcagtcagcagtcaaattagtttctcttctgaataaacaaatgaaactagagttgtttttatatttataaataaaaaatatacaaaacaaggaaaccagctaataaacataaggactgaacattagctggtgtcattaaagccgtacagtgagtatgaaatccaaaaggtaacctcacttagactttataaatggaatgtcccaggctgtgctccagataggctacttggtctctgcgggaacagaaggcccatcttgtggggtggcagcttctgccgctgcagagacaggctcggctgcagtagtaatgtcacacagagcagaggtatcttctgtgtgactggaggcagcctccgtctgattggagcagtcaggctgagaagttggggtctcttgactcaggctggcatccgttggactgggtgtgaggttagcttgaacagaccagtttcctcttctgcttccatttctgtttcttggctctgaacctcctca

SEQ ID NO: 228 - DNA, 420 bp, Rattus rattus
  misc_feature (123)..(123): n is a, c, g, or t
aggattctttttgtaatttacatttatttgttttaaattaattaatatgtgtgtgtgtgtctgtgtctgtgtgtgtatatgtgggtacacacataccacagtacacaaatggaggttagaggncaacttggggggatcccagcaatagaacttgggctgttgggcttggtggcaagtgtgtttacccagtgggccacctcctggttcatgactgagatttatcgaaggtctgtgatcgtcacaattctgtctttgacagtgacatggctgcagtcacagaacagcggtgggtctctgccatgggggtgaaagcctttctgccggcaggttgaaatctcttgaaggccatagtcagtttaatttaaagaatccagtctcctgggaacttggggggagcagacaattgctatggactctggg

SEQ ID NO: 229 - DNA, 469 bp, Rattus rattus
gaaaatgttactcttttattatttcaaggaggtaatacatagcccagtacaccaaagcaatggggaatcagaggcagcaaatggccagtggtttggggaagaacctcatgctgcatctccaagctcccgtctgcctgctcgcacaggctgggacagcggcatgagcttgctatgactgtagcagtggataggtgagcaaactcagccggtgcagaggcagttccagaattcagcacacggacagcacttgccttcctgctggtcactgtcccagcagcagctagcttgcctagcacttgactgtgtttcagagagcctggagtgggcagggcaggagtaaatcctgagtgatcgattacggtgaagccttagtagtgttaacaccctggatgagaaaagagcactgtcttggagggtgggtggggagaaaggactagaaggagcctgggctgcagcactgccgtgagga

SEQ ID NO: 230 - DNA, 9731 bp, Rattus norvegicus
ccgccggcctgcggccgagcgagcgcggcggaggcgctggcgctgggcaattcggtgactcctttctcctccggagcgaggaaggaaggaaggagagaaggaaggaaggaagcgaagaaggaggggactgtctccatggaaggttcaggcggaggcgccctcgccttgcgggtgcaccggccgcagagcagttccagccgccgccggctggcccccggcgcgtggagacgggtgaagtccctgagttttgtcaaagccaacgataatcagatctacttgaaagattaagtgaattgatttgattggaacattctctcaacagccagccaataggaagtgtcaggacaatcatgcccatgagaactctcaactgttcaggtgattgcacttcagtgaaactggctgttgaacattgctggagttgatgggcagaatttctcctggactattcatcatcccagtcccatcctagttgagagagatttaaatgccataagaatcctttgtaacgttgcactttgcttttgaagatggacatttctaggatggagagaactgttatagtttggttccaggacattggcatccaatgcccactgactccagtgtgagcctggaaggttccagagagagagggaacaatccacgcgtttgcagacgaccaggaacgcagaagcaacccagctttacaaagcacagcgttggagacacctccatgagtctgcttggcttccgggcaaagtagcacttaagaccttgtgttaaaatggacactggggacacagctctaggacaaaaagctacctcaaggtctggagaaactgacagtgtgtcaggtagatggaggcaggaacaatcagccggtcttaagatgagcactttcagcagtcaggaagggcagagacaaccgcaaatagatcctgaccagatcggaaatgtagcttcagctcagctgttcggttctgggaagctggcctcgcctggcgagggcgtacatcaagtcacagagaagcaatacccaccacaccgtccgagtccctacccatgccaacattcgctctctttccctcagcactcattgccccagggcatgatgcacagcaacaagccgcaccagagcctcgagggccctccctggctcttctctggccctttgccatctgtggcctctgaggacttatttccttttccaatgcacggccacagtagtggttaccctagaaaaaagatctcaagtctcaaccccgcttacagccaatactcccagaaaagtatcgaacaggcagaagatgctcacaaaaaagagcacaaacccaaaaagccgggcaaatacatctgcccgtactgcagcagggcatgtgcaaaaccaagtgtcctgaagaaacacatcaggtcccataccggtgagcggccgtatccgtgtataccttgtggtttctctttcaagacaaagagcaatttgtacaagcacaggaagtctcatgcccacgcaattaaggcaggcttggtacccttcaccgaatcatctgtgtctaagctggacctggaggctggctttattgatgtagaagcagagatccactcggatggtgaacagagcacagacacggatgaggagagctctttatttgctgaggcttctgacaaagtgagccccggccctcccatccctttggacattgctagcagaggtggctaccccggatccttggaagaatccttgggaggtccgatgaaggtgccaattttgattatccccaaaagtgggatcccgctacccaatgagggctctcagtatctgggccctgacatgctcccaaacccgtctttgaatgctaaggccgatgactctcacacagtgaaacagaaacttgcactgagactgtcagagaaaaaaggacaagactctgagccatccctcaaccttctgagcccacacagcaaggggagcacagactctggctacttttctcgctcggaaagtgcagagcagcagataagcccacccaacacaaacgcaaagtcttacgaagaaatcatctttgggaagtactgtcgactgagtcccaggaatacactcagtgttacccccacgggtcaggagcgtaccgccatggggcggaggggcctcgtggaaccattacctcatgtaaacaccaggttggaggtcaagatgtttgaagatcccatcacacagctgattcccagcaaaggagaaatggaccccagtcaagtcaacatgttgaagaccacgaagttcaacagtgagtgtcggcagccacaagccatggcggcatctgttaggaatgaaggaaaaccttacccaggaagtttcccaggcagcaatcccattctcttagaagctcccgtggactcttcaccccttattagaagcaactcaatgccaacttcttcagcaactaacttaagcatccctccttctttgagaggaagccactcgtttgatgaaaggatgacgggctctgatgacgtgttctatcccggcactgtaggcatacctccccagcgcatgcttagacgacaggcagccttcgagctgccatcggtgcaagagggtcacatggagtttgagcaccctgcaagggtacccaagatccttgccggctcatccctgaaggaaaagaaattagttcccggagataggtctggctatgactatgatgcctgccgtaaaccgtataagaagtgggaagaccctgaaacaccaaaacagagctacagagatatctcttgcttgagcaccttcaaacatggaggggaatattttatggacccctcagtgccattgccgggagtgccaaccatgttcgggacgacctgcgagaacagaaagcgcaggaaggagaaaagtgtaggggacgaggaggatacgcctatgatctgtggtggcatggggagtgctcctgggagcatgatgtcctcagagtatgactccaagctgcaggacggaggaaggagtggcttcaccatgactggacatgagagtcttcctcatggttactccgatcgtttagacctggcccggccccagctgccgtctagaagtccgtctcttgggtctgaggatttgccctcggctggtgatcctgacaagatgacagacctgggcaagaagcctccgggaaatgtgatttcggtgattcagcacacaaactcgctgagccggcccaattccttcgaaaggtctgagtcaacagaaatggcagtcagtacacaggacaagaccccctcaccttctgagatgggcgacagtgaggttttggaaggccccgtaagcccagagtgggctcctccaggggatggtgcagagagtggaagcaggccaaccccttcacagcaggtacctcagcactcctaccatgggcaaccaaggcttgttcgccaacacaacatccaggtccccgaaatcagagtcacagaagaacctgataagcccgagaaggagaaggaggctcctaccaaggagcccgagaagcctgtggaagaattccagtggccccagagaagcgagactctttctcaactccctgctgagaagttgcctcccaaaaagaaacgcttgaggctcgcagatatggagcactcctcaggggaatccagtttcgagtccacaggcaccggcctctctcggagtcccagccaagaaagcaacttatcccacagttccagtttctccatgtcctttgacagagacgaaacggtcaagctcaccgcacctcccaagcaggatgagagcgggaagcattccgagtttttgactgtccccgcgggttcatactcattgtctgtcccgggtcaccaccaccagaaagaaatgcggcgttgctcctctgagcagatgccctgtcctcacccgacggaagtcccagaaatacggagtaaatcatttgattatgggaacctgtcccatgctccagtggcgggagcatccccatcaacattatcgccatcccgggagaggaagaaatgctttctggtacgccaggcttccttcagtggctccccagaaattgcccaaggtgaagccggcatggaccccagcgtcaagcaggagcagctggagcagctgcatgctggcctcagggctgcatggaccactgtgctcccacccctgccaggggatgacccagggaagcaggtggtcggtccttgtggccagctgagctcagggccaccgctccaccttgcccagcaacagatcatgcacatggacagtcaggaatctctgagaaatccgttgattcagccaacatcctacatgacaggcaagcacttacccgaacaaccgcacctgtttccacatcaagacgcggtcccgttttctcctatccagaatgccttgtttcagtttcagtacccgactgtctgtatggttcatttgccagctcagcagcctccctggtggcaggcgcatttcccccatcccttcactccacaccctcagaacagctacagcaagcctcctttccaagctgacattcattctagctattccttagagcacgtagcagaacacactggaaagaaatctgctgactatccgcatgcaaaagagcagacttacccgtgctattccggagcatcagggctacactccaagaacctccctccgaagtttccatcagaccctggcagtaaatccactgaggctccgcccactgaacagcttcttcgagaagattttgcctcagaaaatgctgggcctttgcagtccctaccgggaacggtggttcctgttcgcatccagacccacgttccatcctatggaagtgtcatgtacacaagcatttctcagatacttggacagaatagccccgccattgtcatatgcaaggtcgatgagaacatgacccaaagaacactggtaaccaacgcggccatgcaagggataggatttaacatagcccaagtgcttgggcagcgcacaggcttggaaaaataccctctttggaaagtacctcagaccctacccctgggcttggaatcctccatccccttgtgtttaccgtccacctcagacagcgcggcctctctcggaggaagcaagcggatgctgtctccagccagcagtttggagctcttcatggaaaccaagcaacagaaacgggtgaaagaggagaagatgtacgggcagattgtagaagagctcagtgctgtggagttaaccaactcggacatcaagaagggcctctcccgcccccagaagccccagctcgtgaggcaagggtgtgcctcggagccgaaggacggcagctctcagtcaaggtcatcttccttctcctccctgtcaccctcctcgtctcaagaccatccggctgccagcgggcctttccctcccaacagggagatactttcaggttccagggcgccgccgcgacggaagttcagtgggccctcagaaagcagagagtcctccgatgagctggacatcgatgagacctcgtcagacatgagcatgagcccccagagctcttcgctgcccacaggaggcagtcagcaggaagacgaagggaaggcccgcaagctgccagtcagcatgctagtccacatggcctctggtccgggaggaaatgtggcaaattccactcttcttttcacagacgtggcagatttccagcagatccttcagttccccagtctgcggacaacaactactgtgagttggtgcttcttaaattatacaaaacccaattttgtgcaacaggccaccttcaaatcctccgtttatgcttcatggtgcattagttcctgtaacccaaacccatcaggattgaacaccaagaccacgctggccctcctgagatccaaacaaaaaattaccgccgaaatttacactctggctgctatgcacaggcccggaactggcaagctcacatcatccagtgcctggaagcagtttgcacagatgaaacctgatgcacccttcttgtttggcaacaaactagaaaggaaattagggggaaatgtcttaaaggaaagagggaaaggagagattcacggagataaagatcttggatccaaacaaaccgagccaatccgaattaagatctttgaaggggggtacaaatccaatgaagattatgtgtatgtcagaggacgtggacggggaaagtacatttgtgaagagtgtggaattcgctgtaagaagccaagcatgctgaaaaaacatatacgcactcatactgatgttcggccttatgtatgcaagttatgtaattttgccttcaagacgaaaggaaacctaacgaaacacatgaaatctaaggcccacatgaaaaagtgtctggagctgggcgtctcgatgacatcagtagatgagacagaaacagaagaagcagaaaatatggaagatttgcacaaaacatctgagaagcacagcatgtccggcatttcaactgaccaccagttctcagatgctgaggaatctgacggagaggatggagacgataatgatgaagatgatgaagacgatgatgactttgatgaccaaggagatttgacacccaaaacaaggtcaagaagcaccagtcctcagcctcctcggttctcctccttgcctgtcaatgttggcgctgtagcccacggcgtcccctcagatagctctctgggacattcgtcattgatcagctatttggttactctacccagtattcaggtcactcagctcatgacacccagtgactcttgtgaagacacccagatgacagaatatcagaggctgttccagagcaaaagcacagactccgaacccgacaaagacaggttagacatcccaagctccatggacgaagaggccatgttgtcttcagagccaagctcctccccaagggacttctccccctcaagctaccggtcctcaccaggatatgattcttcaccctgtcgagataattcgccaaagaggtatctgatacccaaaggagatttgtcacccagaagacatttatcacctagaagagatctatcacccatgaggcatctgtcaccaagaaaagaagctgcattgaggagagagatgtcccaaggggatgcttcaccaaggaggcatttgtccccacggagaccattgtctcctggaaaagacattacaacaagaagggacctctctcccagaagagagagaagatatatgactaccattagagcaccatctcccagaagggctttataccataacccaccattaccaatggggcagtatctgcaaacagagccaattgtattggggcctcctaatctaagaagaggattacctcaggttccttacttcagtctctatggagaccaagaaggtgcttatgaacatcacggctccagccttttccctgagggtcctactgactatgtcttcagtcatcttcccctccattctcagcagcaagtgcgagctcctatccccatggtgccagttggtgggatccaaatggttcactccttgccgccagccatttccggtttacatcctccacccacattgcctctgcccacagagggctctgaggagaagaaaggagcacccggggaggccctcacccaggatccctacaccctttccaggcggcatgagaaacaagcccctcacgttttgcagtcatctggtctacctagttctccctcctccccacggctattgatgaaacagagtacttcagaagacagcctaaattccacagagagagaacaggaggaaaacatacagacttgtacaaaagccatcgcctcactccggattgcaacagaagaggcagctctgcttggggctgatcagcccacatgggtgcaggagtccccgcagaaacccttggagagtgcacacatcagcattagacactttagcgggcctgagccaggtcagctctgtacctcagccgcccaccctgacttacacgatggtgaaaaggacacttttggtacatcacagactgcagtagcccaccccacgttttacagcaagggcagtgtggatgagaagcaggtggactttcagagcagcaaggaattatctttaagcacagaggaaggcaatgagccctcatcggaaaagaatcgactccattgatctgcaatgcatggacacattcatttccacatttccccctccccccttttgtttttgtttttctagggatagaaataaacgagttgatagcatgcctgtcctaagttacagtagttggctattataaatacttttgttattttgaagacaattagggaaattaacaagtcatcttgagcctgaccaaaacaaaatttgaaattaacctattgggtctggtaactttgaaaaaaattgtacagatgtttgtgccttttctttactttgcttatattcttataagcatttttttagcggtaatttgtacatattttagaatttgtgtatctgctttgtaataaatgtaatctctttcctcttttggacacttggatcttaacgacgtaaagcaaagcagcatctatatatattgtgaggttgcactaaaacatatttttatatgataaaactgaacagcttttatgtacagctctcattctgtaatactaatatttattttgtttcataaactgtacatttttttcttaatgttgtggattgcttttctatgtgaagcatgggttccctgttgcgtaactagaacagaaatgtccattgtaagcaagatatttaaactagaatatcttattctgcacttatgcataagttacaaaaaaaagataaagaacgtatcagtcggttcttaacctgtaaattctttttgtctcttgtttgccggattgacaataacttaagagctgattgtgatttttaaatggatagtaccgtaaagcattaaagtaaacaatgtgctattgtgagtttttttcaaagctttataaatcagttataaataatattaaaagtatttggtcttatgtgaacatgttgatctatatactcaccttaaaaaatatgggaaaaacattccgcccccatgtaaatatgtacaagtgcatcactggtacagttttgtgttactcggttggacacgaggttgccacagacctatgctagagtgtctttaaaattaaagtgagaaagcacatggactgtgtagagcttggttatcggccggcccggtggcttggtaggcagtgctgtgcgctgcctgtggagaagacctgggcttaaaaatcttggttcttgctgcacaggatggtgactggaactaaggctgcatggagggttcgcacttggactcgagggttgggtgtggaagtggggaagagggatggagacctgctccccagctcttcccatcagcctgtccataatggttacagggttaccatcagcattaggaaatgtcaccttaccctttgaatagggaaagagtgtcactcctggctgtctcagggggaatgaagcagagaggccttcaaaagaaagcagctctggggagaaggaagtttttttgtatctaaccttcagaacggcttttgatcagtgttgaaggtgggaagagcctttgcaggtctagaagagcagagcagagggaggggtacagcaacatgtgcacacgcatgcacatgtatgtgcatgcgcacacacaatctgggttatctttgtgctatatagtggattataattctgtgaaaccaagtttgtatattgaattacattaaggagtgttctttaaaaagagaaataaatatacaattacatgctt

SEQ ID NO: 231 - DNA, 4198 bp, Rattus norvegicus
gacgcgctgagccgctgccgccgcgggggggaagcctgcgagtagctcgcgtgcccgcagtccgcgtaagccccgcgccccttccacccctggccaggccatggcggaacgtggaggggcgggcggtggtcccggaggcgccgggggcggcagcagtcagcggggctctggggttgcccagtccccgcagcagcagccgccgcagcagccatctcagccgcaacagccaacgccccccaaactggcccaggccacctcgtcctcctcgtccacctcggctgcggccgcctcctcctcgtcctcctccacctccacctccatggccgtcgcggtggcctcgggctctgcgcctcccggcggtccgggaccaggccgcacccccgccccagtgcagatgaatttgtatgctacctgggaggtggaccggagctcatccagctgcgtgcccagactcttcagtttgactctgaagaaacttgttatgcttaaagaaatggacaaagatcttaactcagtagtcattgctgtgaagctgcagggttcaaaaaggattcttcgctctaatgagatcatccttccagccagtggcctggtggaaacagagctccagttaaccttctccctccagtaccctcatttccttaagcgagatgccaacaaactgcagattatgttgcaaaggaggaagcggtacaagaaccggactatcttgggctataaaaccttggctgtgggactcatcaacatggcagaggtgatgcaacaccctaacgagggtgctttagtacttggcctgcatagcaacgtaaaggatgtctctgtgcctgtggcagaaataaaaatctactctttatccagccagcccattgaccatgaaggaatcaagtctaagctgtctgatcgctccccagatattgacaactactctgaagaagaggaggaaagcttctcctcagagcaggaaggcagtgatgacccattacatggacaggacctattctatgaagatgaagatcttcggaaagtaaagaagactcgaaggaaactgacctcaacctcagccatcactaggcaaccgaacatcaaacagaagtttgtggccctcctgaaacgattcaaagtttctgatgaggtgggctttgggctagaacatgtgtcaagggagcagattcgggaagtggaagaggacctggatgaactatacgacagtctagaaatgtacaaccccagcgacagtggccctgagatggaagaaacagaaagcatcctcagcaccccaaagcccaagctcaagcccttctttgaggggatgtctcagtccagctcacagacggagatcggcagtctcaacagcaagggcagccttggaaaagacaccaccagccctatggaattggcagctttagaaaaagttaagtctacttggattaaaaaccaagatgacagcttgactgaaacagacactttagaaatcactgaccaggacatgtttggagatgcgagcacaagtctggttgtaccagaaaaagtcaaaactcctatgaagtccagcaaagctgatctgcagggctccgcctcgccgagcaaggtggaagggacacacacacctcgccaaaagaggagcactcccctgaaggagcggcagctctccaagcccctgagtgagaggaccaacagctctgacagtgagcgctctcctgacctagggcacagcacacagattccacgaaaggtggtatacgatcaactgaatcagatcctggtttccgatgcagcgctccctgagaatgtcatcctggtgaacaccacggactggcagggccagtatgtggccgaattgcttcaagaccagaggaagcctgttgtgtgtacctgctcaacagtggaggtccaggccgtgttgtctgccctgctcactaggattcagcgctactgcaactgcaactcatctatgccgaggccagtcaaggtggcagctgtgggcagccagagttacctgagctccatccttcggttttttgtcaagtcccttgccagcaagaccccggactggctgggccacatgcgcttcctcatcgttcccctaggttctcatccagtggccaaatacttgggctcagtagatagtagatatagcagcacctttcttgattctgcttggagagacctgttcagtcgctcagagcctccagtgtcagagccactggatgtggtgggtcgtgtgatgcagtatgtcaatggagctaccacaacgcaccagctgcctgtggctgaagccatgttgacctgcaggcataagttccctgatgaagactcctaccagaagtttatccccttcattggtgttgtgaaagtgggccttgttgaagactcgccctccactgcaggtgatggggacgattcacctgtggtcagccttactgtgccctccacatcaccaccctcaagctcgggcctgagccgagatgccacagctacccctccctcatccccatccatgagcagtgccctcgccatcgtggggagcccaaatagcccttatggggatgtgattggcctccaggtggattactggctgggccaccctggggagcgaaggagagaaggtgataagagggacgccagttcaaagaataccctcaagagtgtcttccgctcagtgcaggtttctcgcctgccccatgcaggggaagcccagctttctggcaccatggcaatgactgtggtcaccaaagagaagaacaagaaagtgcccactatcttcctgagcaagaagccccgggaaaaggaggtggattctaagagccaagtcatcgagggcatcagccgcctcatctgttctgcaaagcagcagcaaaccatgctgagagtgtccattgatggagttgaatggagtgacatcaagttcttccagctggcagctcagtggcccactcatgtcaagcacttcccagtgggactcttcagtggcagcaaacccacctgagacctgcctcccaaccactccctcctggcactgccacccagcccagcctcctttcctagcactggggcttgcctccacttgcccagtcctgaaggacactgccactggggatgcagtcctccctgctcactgcccagccatctctgcccagctcccccctgttccaggcccagagctgggtgatcctgccttctggtgcccataattcctgtaattgaataatctgggccttccttcacctcacccctgcagcgctggtaccctttctagaaatgaaacacctggagttctggtacacagggagacagcccagcatcctacataagctggccacccagctctgcatttctaaggctctgttgcctgttgtactcaccctgccttcctccagcagggctggggcctcctgccattcctcacctgcctcacagtttcccagtagggggaaggaggatggcacctgggcatcctggagtttctgggattgaagggaccttcccagtctcccatgcatgatttcctgacacttcaagtcgcttggatgtcctgtgttttgtgtgtttttagttgtttgggtaacttgtcctgtgcacaggtccttaaggctccttctccctctgcctcccagcctcctacctaacattgctctgtggcttcatgaggtaggagacagcaaacccacccacccacccaccccttcacccctcaacacatacatcatctgtggctctcatccagtcatattgtccccctctcctgtgtcagcttgcctcctggctctgctctgtcatcccacttccttcatggcagggcagcagaatgaggcccttctccaccaggtctccctccagcagcctccttccctctctcagccatgaatgggtcccagacctacctcagcctccttatcagtgtcttcatgagaggctgaggacaagggacagatctggcccagcctccatgccctctgtgtcctatggcacctcagagcttctccgttgcccctcagtgtttcctagcagtgtggcacggaactgcacttggaacctagttttggtgttcttcacatccaaaactcttaagcccctcccgctgcccagcctgtccagagtatctcctgggcctgagaataagtggggtgggaagactggggccatgttgggttttttcattcaataaactggtgatttcttaccaaaaaaaaaaaaaaaa

SEQ ID NO: 232 - DNA, 1294 bp, Rattus norvegicus
ggaattcccggaaaccgttgggcccgagcgaaccgtaccgagcgcgggcatcgcagagcgcgagtgcggagctcggagcgcagcacgatgggaggggagcaggaggaggagcgcttcgacggcatgctgctggccatggcgcagcagcacgagggcggcgtgcaggagcttgtgaacaccttcttcagcttccttcgacgcaaaacagactttttcattggaggagaagaggggatggcagagaagctcatcacacagacttttaaccaccacaaccagctggcacagaaggccaggagagagaagcgagctcggcaggagacagagcgtcgggagaaggcagagcgggcagccaggctggccaaggaggccaaggcagagactcccgggccacagatcaaggaactgactgatgaggaggcagagagactgcagctggagattgaccagaaaaaggatgcagagaaccatgaggtgcagcttaagaacggcagtcttgactctccagggaagcaggatgctgaggaagaggaagacgaggaagacgagaaggacaaaggaaagctgaaacccaacctaggcaatggggctgacctgcccaactaccgctggacccagaccctgtcagagctggatctggcagtgcccttccgagtcagcttccggctgaagggaaaggatgtggtggtggacatccagcggcggcacctccgggtgggcctcaaaggacaggcaccagtgattgatggagagctctacaatgaagtaaaggtggaggagagctcgtggctcatcgaggatggcaaggtggtgacagtgcatctggagaagatcaataagatggagtggtggaaccgcttggttaccagtgaccccgaaatcaataccaagaagattaaccctgagaactccaagctctcagacctggacagtgagactcgcagcatggtggaaaaaatgatgtatgaccagaggcagaagtccatgggcttgcccacctctgatgagcagaagaaacaggaaatcctgaagaagttcatggatcagcacccagagatggatttctccaaggccaaattcaactagctcctgttcaccttcctgaactcttgcagttgagcccgtagccactcaacttcctttcctgagacccaggagccttagggctgggcaggcgtgggacttcccaggcatgtgagctccagggattcactggagaagggctgggtcttgggggtcttgtccttgctatttgtcctgttacacattaaaactatttactctgttccaaagg

SEQ ID NO: 233 - DNA, 448 bp, Rattus rattus
ccatgcaaggagactgtttatttcgaaaggattttgcaataaacacagtgaacagggctccaagtagctgtctattcttctccctcatcctcgtcctcataggagtctatgcctacttcctcataatctttctccagggcagccatatcctctcgagcctcggaaaactccccctcctccattccctcacccacataccagtgtacaaaagccctcttggcatacatcaagtcaaacttgtggtccaggcgggcccaggcttcagcaatggcggttgtgttgctcagtatgcacactgcacgctgcaccttggccaggtcgcccccaggcaccacggtgggaggctggtacttgataccgaccttgaagcctgtggggcaccagtccacaaactggatgctgcgcttcgtcttgatggcatcgatggcagcgttcacatccttgggca

SEQ ID NO: 234 - DNA, 856 bp, Rattus norvegicus
ggcgcttgttcttccctgtgccactccgcaaagatgcagctgaaaccgatggagattaaccccgagatgctgaacaaagtgttggccaagctgggggtcgccgggcagtggcgctttgccgacgtgctagggctggaggaggagatcctgggctcagtgccatctcctgcctgcgccctgctgctgctgtttcccctcacggcccagcatgaaaacttcaggaaaaaacaaattgaggaactgaagggacaagaagttagccctaaagtttacttcatgaagcagaccatcgggaactcctgtggtaccattgggctgatgcacgcagtggccaataaccaagacaacctgggatttgaggatggatcagtcctgaaacagtttctgtctgaaacggagaagttgtcccctgaagacagagccaagtgtttcgagaagaacgaggccattcaggcagcccatgactccgtggcccaggagggccagtgccgggtagacgacaaagtgaatttccattttatcctgttcaataatgtggacggccacctctacgagctcgatgggcgaatgcctttcccggtgaaccatggcgccagttcagaggactctctgctgcaggatgccgccaaggtctgcagagaattcactgagcgcgagcagggagaggtccgcttctccgcagtggctctctgcaaagcagcctaagtagggagagagaaccagccgctcccccatccctgggcaggtgcgcgctgccctgcccttggtttgcagctttagcacttaacaaccacagctgtcttcttgcgttctactgccccgtcccctccaccccacccaggccaccagggagctc

SEQ ID NO: 235 - DNA, 3865 bp, Rattus norvegicus
ttttttttcacaccaagcagagtttattgatgccgtgggcggggcccacgtacacagcaggtggcgcacgcagggcagatactcactggctggactgcaggggtgttagcagcggcaaaagcagatgacctgtggggagcaccctttggggggtgccctcctcctagcagcattgggggctttgggtgagcatcaagaaccacctagtcaccctaaggttctcttggaagcccctccccctccttcccgagctccttgtgagttgggggctaggatcccttcctgtgatcaaaggtgggatgatcccttgagattcactataaaaattaaaattcatttataaatcacaagagaagggcaggagggaacaccggggaaacctgacttcatcggttaccttgagcctactcccctccctcaggttctaactccaaaagagagagcaaagagctaggtctacaggcacagaaaggggcgagagacagaggaaaggcagtcggaagaacgggacgagagaggaaaaagatgcatcggaagaaaagtatggctgctgaggctcctctccccaacagctcccgaaagccatgacctggggataaaggagaaaagttcccagcccagagactcctacaaggtaaggttccaaatgtccccgatccggtccttgctcaagccatggcgggccttgagatactcagagctgtgtggatgggagctgagggaggcgagtgctactccaggtagatatcttctgtggggcaggcgaatgccaggtgctcctggtagtactccaggaaggcccggcccacgctccttgccactggcctcatagactcctgggacacaaagacgtggcaggcaaagcggcttagcagcgggtgtttggtaatgaagccaaaatagcagctgtttcggggatgacagccacagaaggagatgttcttcatctggaaaaagtggctgcaacgccctggtttgacctgaccatgatgcccaagactggcactttttgttttttctcagcaaactgtacaaccccaaatctctttttgattttcaaggaaactagattcctgccagaatttgagtctggacaataaatagacactttgtcctagtcttctttctggaatcatttcgggatattttccacaagcatcacggaaacaggaatgaaccggcagctagtgaacattttgacagccttgtttgcatttttcttagggacaaaccacttcagggaagcattctgcaaagaccatgactccaggtctggaaaacatccctcgcagaccctgtctccttcagatttcttggataaactaatgggaaggacatcaggatatgatgcaagaatcaggccaaattttaaaggtcctccagtaaacgttacttgcaatatttttatcaacagttttggatcggtcacagaaaccaccatggactaccgagtgaacatttttctgagacagcagtggaacgattcacggctggcatacagtgagtacccagatgattccctggatttggatccatcgatgctggattcgatttggaaaccagatttgttctttgccaatgagaaaggagccaatttccatgatgtcaccactgataacaagttgctgcggatttccaaaaatggcaaagtgctctacagtattagactcaccttgactttatcctgtcccatggacctgaagaactttccaatggatgtccagacctgtacaatgcagctggagagttttgggtacaccatgaatgacctgatatttgagtggttaagtgatggtccagtacaagttgctgaaggactcaccctgcctcagtttattttgaaagaagagaaggaacttggctattgcacaaagcattacaacactggcaagtttacctgcattgaggtcaagtttcacctggaacgccagatgggctattatttgatccagatgtatatccccagcctgctgatagtcattttgtcctgggtctccttttggataaacatggatgcagctcctgccagggttgcccttggcatcacaaccgtcctgacaatgactacccagagttcaggttccagggcatctctgccaaaggtctcatatgtgaaagcaattgacatctggatggcagtgtgccttctgtttgtgtttgctgccttactggaatatgcagcagtgaactttgtctccaggcaacacaaggagttccttcgtctccggagacgacagaagaggcagaataaggaagaagatgttactcgtgaaagccgttttaacttcagcggttatgggatgggtcactgcctccaagtgaaagatggtacagctgtcaaggctacacctgccaacccacttccgcaacccccaaaagatgcagatgctatcaagaagaagtttgtggatcgggcaaaaagaatcgacaccatatctcgagctgccttcccactggccttcctcattttcaacatcttttactggatcacatacaagatcattcggcatgaagatgtccacaagaaatagatgtatcctattgaccctgggaccttctttgcctaagtgttgtgcttgtaaatacacagtaatagtgtctttatattgctttgacagagaacattgagggtggggggaggaaaatcatgagggtggggtttctggcacctacatgacaaaggacaggttctatgggcaaggaagaaaactgcacaaaattaaggtgttgcagaatcacatgagcataactcccatccatagtctatagcattgttctttcagaggacacatcactcagacatgatatgcaaggtcaagttcttgagggctggttatcttatggtttgatttgacaagttctggttctgaaaggttagtttaatgcacacacacacacacacacacacacacacacacacacacacacacacagaaaatgcttaccatctgacaatagtgactaccatatagtaaattgaggaccaaactttttcaggaaaatgctgcctcatttttaaaacaagcctcctgagctatgatatttacaatgtctgtaattagtgtttcacccaagaaatccttttgtgggttgtaaattctttctacaaatccaggaaacaacaacaagataaacacaaatgactaagagcagatttctactctgctgtctgtgtaggtgtgcactttgatattatttttctttcctagatataatgtgggggcttccttgtgtattgcgtaattgatttactggtatatcctcttaaaagaaatgctcattttattttagatcaagttagcatattatgtatattttttcactttggctatacttatgtgtgactttaagtgcccaagtgtaatttagctattgcagctgctatgccacagtatttatggagacggtgtgttgtgattggtgtatctcagagtagctcaaacttcccatttctgccctcattgtagctgtaactactagtcctaatgttgactgacctgtaatttgtactttcaatccaagtgaatatcgttttaaatatccttgattaactgaaaaaaattcaaactgtactgtgattttcataacccgttgccttttcggtatcagagctacgtggtttgaatcctggctacatgttttaagtaagaaaaaaaatatgtatttttgcttactcaaaagacaacctgtaaagttatatggaaataattacattttacatgtgctgtaaaagggattattttaaaaaagcatttgttcagtttcaataaaggtaagtgtgccaccaaaaaataattcccatgttgctggtggtggtagttgttgaatagctgttggcattggtgaaaaaggagctggaactggc

SEQ ID NO: 236 - DNA, 1087 bp, Rattus norvegicus
ggaagagggaagaaggcgctgaggaccgcgcacgcccagcccagctgctgacttcaccacctcaccgagacccactccgctggccagcacgctacactgacaggatcctggctgcacccactgtgatctctttgaactaggatagcccgcgctcactgtttccctgaagatggaagaaatcccacccacccactacgctgcgtccagggctgcctcggtggcagagaactgtataaattatcagcaagggacccccaacaaggtattcaaggtgcagacggtccagcaggcaagcaaggaggatatcccaggaagaggccacaagtaccatctgaagttttctgtggaagaaattatccaaaaacaagttacagtgagctgcacggctgaagttctttaccctcgaatgggacaaggctctgcaccggaagtcaacttcacatttgaaggagaaatcggcaagaacccagatgaggaagacaacacgttttatcaaagactcatgtccatgaaggaaccactacaagcacaaaatattccagacaattttggaaatgtgtctccacaaatgaagccggtccaccacttagcctgggtcgcctgtggttatgtaatgtggcagaactcgactgaagacacatggtataaaatggcaaagattcaaacggtcaagcaagtgcaaagaaacgatgacttcattgagttagactacaccgtcctactccacgacgttgcatcgcaggagattatcccctggcaaatgcaagttctgtggcacccacaatacggcacaaaagtaaagcacaacagccgcctcccaaaggaagcaccagcagagtaaacaagaccccaactcggagacagccgtcaacatgccccttaaccatgagtatgactgtcctcactggcacctagctaacaggccaagtgaatcccacagtgtcgctctgtatgtcttggctacaggaccgagctgcatagattccacaataaagagtagactacatgaaagtgtctttccaatagtaatggtactatggctatccactaataaagtcaacttcagcctcacaaaaaaaaaaaaaaa

SEQ ID NO: 237 - DNA, 1740 bp, Rattus norvegicus
cggaaacagtgtcaagagagtaagggcacagaggacttgctgaaaatgaatgtatgtacgttcactcttgtcttggcattagtcggtagtgtcagtggccaatactatgattatgatgcccctctcttcatgtatggggaactgtcacccaactgtgcaccagaatgtaactgtccccacagctacccaactgccatgtactgtgatgatctcaagttgaaaagtgtgcccatggtgccccctggcatcaagtacctttacctgaggaataaccagatcgaccatattgatgaaaaggcctttgagaatgtaacggatctgcagtggctcattcttgaccacaatcttctagaaaactccaagatcaaaggaaaggtcttctctaagctgaaacaactgaagaagctgcatataaactacaacaatttgaccgagtccgtgggtccgctcccaaagtccctacaagaccttcagctggccaataataagatcagcaagctgggctccttcgacgggctggtaaacctgaccttcatttaccttcaacacaaccagctcaaagaggaggctgtctcggcttctctgaaaggccttaagtcactcgaatacctcgacttgagcttcaatcagatgagcaagctgcccgctggccttccaacatctcttctaactctctacctagacaacaataagatcaccaacattcctgatgagtatttcaatcgcttcaccgggcttcaatacttgcgtttatctcacaatgagctggctgacagtggcgtgcctggaaactcatttaacatatcatctctgctcgagctcgatctctcctacaataagctcaagagtataccaaccgttaatgaaaaccttgaaaactattacctggaggtcaataaactcgaaaagtttgatgtcaagagcttctgtaagatcctgggaccactatcttactccaagatcaagcatttgcgcttggatggcaatcccctcactcaaagcagtctgccccctgacatgtacgagtgtctacgtgtagcaaatgaaatcacggttaattaacctcctctcattctaatacattgaagtatgttccagagcagtacttcatggatgggtatttgctggatgtgttaaagttttcacaatatcctttacattgttattgtcattgttgttgttggtattacttcatggattttaattaataaaggaaatgttttgtgaacatttaccactttttaaataaaagatgaaaagcaggcctatttcatcgtgagaacagacacataaaacccgttaaacttaagtctatttgtgaatttaatgttttctatagctctatgttcaggtgattatgaagcctttttactgattgcttggaagtccaccaggtttctatggttcctcacattttacattagtgacttcgaaaacatgaaacaaacatgcatggatgtttgttatcctaatccaaatttttgtgacatgtcaagtttgttttacagaagtttagatcctatgttttgaaaccagtgatttgcaacataccaaagaaaattactaaagacctgtctacttaaagaaatgtagttagcagtaagaatttcccagttacttaatgaaacttttcttgagtcattttcctgtcatatctatgtttctttctgattgtttgcatgttatgattaacaagctgatagcaaaataaaacaatgcaaatggtaaaaaaaaaaaaaa

SEQ ID NO: 238 - DNA, 1504 bp, Rattus norvegicus
gctgcgtggcgtcagggttctggagctggcaggcctggccccagggccgttctgcgggatgatcctggcggacttcggcgccgaggtggtgctcgtggacagactgggctccgtgaaccaccccagtcacctggcccgaggcaagcgctcgctggcgctggacctgaagcggtctccgggagccgcggtgttgcggcgcatgtgcgcacgcgcggacgtgttgctggagcccttccgttgcggtgtcatggagaaactccagcttgggccagagactctacggcaggacaatccaaagctcatctatgccaggctgagtggatttggccagtcgggaattttctccaaagtagctggccatgacatcaactatgtggctttgtcaggtgtcctgtcaaagattggcaggagcggtgagaacccataccctcccctgaacctcctggccgactttggtggcggtggcctcatgtgcacattgggcattttgctggctctcttcgaacgcacgcggtctggcctagggcaggtcattgatgcgaacatggtggaaggaacggcatacttaagtactttcctgtggaaaactcaggccatgggtctgtgggcacagcctcgagggcaaaacctgttagatggcggggcacctttctacacaacctacaagaccgcagatggggagttcatggctgtaggtgcaatagaaccccagttctacacactgctgcttaaaggacttggacttgagtctgaggaactccccagccagatgagcatagaagattggccagaaatgaagaagaaatttgcagatgtgtttgcaaggaagactaaggcagagtggtgccagatctttgacgggacagatgcatgtgtgaccccagtgctgactcttgaggaggccctccaccaccagcacaacagagaacggggctccttcatcactgatgaggagcagcatgcatgcccccgtcctgcaccccagctttccagaacccctgctgttccttctgccaaaagggacccttctgtgggagagcacactgtagaggtgcttaaagactatggattcagtcaggaagagatccatcagctgcactcggatagaatcattgaaagtaataagctaaaagccaacctctgactcaggttcacagctcaagtgaatctgaaggctgtatctgtactggagaaggatgcccaccactgtccgtatggaaatgtgaatgaacagtaatgaagtaatccaaatattccaatcaagacacaacgaaagactgattacagagaaatgactgtgctctcacactgctcatccgagcctctgattgaggagtatttttgtgtgtgtactgatattaacttgtggcagttttctgcctttcagcttacttggtgaagtgcattcactgattaaaacccttttgtaaatgcaactctgataatatattaaatgaactaatataactttaataaataaagcttttttttccttgaaaaaaaa

SEQ ID NO: 239 - DNA, 505 bp, Rattus norvegicus
ttcggaactgttctgtgggaccaagctgcggagtcaggccaacatgagtgagagacaaagtgctggagcaaccaatggaaaagacaagacatcaggagataatgatgggcagaagaaggtccaagaagaatttgatatcgacatggatgcaccagagacagagcgtgcagctgtggccattcagtctcagttcagaaaattccagaagaaaaaggcaggatcacagtcctagtggggaagctgccttccttgttcacccgaagacaccaagttcaaccaccgtccatccagaaatgagaagaacaataccctagagcaaagtcatccacacccagtacacactccgctgctaacctgaaatgcatgaacagaaacccatagtatttatgcccctctaggcaggtgtccacaataaaattgtgagcagcttaatctgtctgtctccattacaattcctctgcaacgattttcctcgatgttgtaataaaaaggaggtaagagccga

SEQ ID NO: 240 - DNA, 797 bp, Rattus norvegicus
  misc_feature (74)..(74): n is a, c, g, or t
  misc_feature (541)..(541): n is a, c, g, or t
  misc_feature (544)..(544): n is a, c, g, or t
  misc_feature (558)..(558): n is a, c, g, or t
  misc_feature (605)..(605): n is a, c, g, or t
  misc_feature (614)..(614): n is a, c, g, or t
  misc_feature (794)..(794): n is a, c, g, or t
agccctgggccccacaactgcaagcagagccggagccgcccagttacagcgggacccgggcctctggggtccanacaggggtcgccatgatccgattcattctcatccagaaccgggcaggcaagacacgcctggccaagtggtatatgcagttcgatgatgacgagaagcagaagttgatcgaggaagtgcacgccgtggtcaccgtcagggatgccaagcacaccaactttgtggagttccggaacttcaagatcatctaccggcgctacgctggcctctacttctgcatctgcgttgacgtcaacgacaacaatctggcctatcttgaaggcatccacaacttcgtagaagtgttaaatgaatacttccacaatgtctgtgaactggacctggtgttcaacttctacaggttttacacggtggtagatgagattttcttggcaggagagatccgagagaggagccagacgaaggtgctgaagcagctgctgatgctgcagtcgctggagtgagggggggcttccgccccagcccggcntgntgggccaacatgcntgtttgtcccctgccaggtttgaggcccaccccagcagccccttccnttctttagntggcccagaggagtgacccagcagggtttaggccacaggggaggaggccagaacccactgcctttgggccctaagtggatggcagaggccaccgtgatgtcccgagtaactgtgccattattgtgtgatgctgtgagtgtgcgtgtgtgcagcccccaataaacctgtggtcctgcctgnaaa

SEQ ID NO: 241 - DNA, 2155 bp, Rattus norvegicus
gggcacgccggagcccgaacggcgcagcctggaagaggccggagcccaagggaggcggcggtagaggcagcggcgggggcagcccaggcagcccgagccccgcggcctgggcctgcgctcggcgccatgagcggcggcgggccttcgggaggtggccctgggggctcgggccgggcgcggaccagctcgttcgcggagccaggcggcggaggcggaggcggtggcggcggccccgggggctcggcctccggcccaggaggcactggcggcgggaaggcgtcagtcggggctatgggtgggggcgtgggagcctcgagctctgggggtggccccagcggcagcggcggaggaggcagcggtggccccggcgcgggcactagcttcccgccgcccggagtgaagctgggccgtgacagcgggaaggtgaccacagtggtagccactctaggccaaggcccagagcgttcccaagaggtggcttacaccgacatcaaagtgattggcaatggctcattcggagtagtgtaccaggcacggctggcagaaacgagggaactggtggccatcaagaaggttcttcaggacaaaaggttcaagaaccgagagctgcagattatgcgtaagctggaccactgcaatatcgtgaggctgcggtactttttctactccagtggggagaagaaagatgagctgtatttaaatctggtgctggaatatgtgcccgagaccgtgtaccgagtggcccgtcactttaccaaggccaagttgatcatccctatcatctatgtcaaggtgtacatgtaccagctcttccggagcttggcctacatccactcccaaggtgtgtgtcaccgtgacatcaagccccagaatttgcttgtggaccctgacactgctgtcctcaagctctgcgactttggcagtgcaaagcagttggttcggggggagcccaacgtgtcctacatctgttctcggtactaccgtgctccggagctcatctttggagccacagattacacctcgtccatcgatgtgtggtcagctggctgtgtactggctgagctgcttcttggccagcccatcttccctggggacagtggggtagaccagcttgtggagatcatcaaggtactagggacgccaaccagggagcaaatccgagagatgaaccctaactacacagaattcaagttcccccagatcaaagctcacccctggacaaaggtgttcaaatctcggacaccacctgaggccatcgcactctgctctagcctgctggagtacactccatcctcaaggctctccccactagaggcctgtgcccacagtttctttgatgaactgcggagtctcggaacccagctccccaacaaccgcccgcttccccccctcttcaacttcagtcctggtgaactttccatccaaccgtctctcaatgccattctcatccctcctcacttgaggtccccatcaggccctgctaccctcacctcgtcctcacaagctttaactgagactcagactggccaagactggcaggcacctgatgccacacctaccctcactaactcttcctgagggccctaccgactacccctcacgctcactcggaaggctcaagtgggctggaaagggccatagcccatccagctcctgcctgctggccctagactgagggcagaggtaaatgaactacccagcatctaggcctccctcaccagcctcaccttgtggtggcttttaaagaggatttaactgtttgtgggggagggaagggaagagaaggacggacggggtttggggtatgaggaccttctacccccgtggtcccctcccctcccccaggctaccactcctcccccccctcccatgtcccttgtaaatagaaccagcccagccgtatcctcttcctggcccttgggtgtaaatagattgttataatttttttcttaaagaaaacgtcgattcacaccatccaacctgccctccccctcagctgtacccccctcttgtcctctgctcccaaggcttcctccctctccccatcccaaggaggggagtagggagagcccctggtgtcttagtttccacagtaaggtttgcctgtgtacagacctccgttcaataaattattggcatgaaaaaaaaaaaaaaa

SEQ ID NO: 242 - DNA, 4871 bp, Rattus norvegicus
ttttaagcgccacggggacccgctggcgctgccatccctcccgggttcctggtcgcgccacgatggggcacctgcctagggaaaggcgcgggggccgccgcctgctacctctgctcgggctctttgtgctgctcaagattgtttcaacgttccacgtgactgtccgagacgacaacaacatcgttgtgtctttagaagcttctgatgtagtcagcccaacctccgtgtatgttgtgagggtagctggcgaatccaaaaactatttcttcgaatttgaggaatccaatggcacactgcctcctcctgtggtctttaaggccacgtatcatggtctttattacatcatcagtctggtggtagtcagtgggaatgtggtcaccaaaccatcccgatcaatcaccgtgctgacaaaacccttgcccgtaaccagtgtgtctatatatgactataagccttctcctgagacaggagtactgtttgaaattcactatccggaaaaatacaacgtgttcagcagagtgaacatcagctactgggaggggaaggatttcaggacgatgctgtacaaagacttcctgaaggggaaaaccgtgtttaatcactggctcccggggatctgctacagtaacatcactttccagctggtttctgaggcgacctttaacaaaagcaccctggtggagtgcagtggtgtgagtcacgaacccaaacaacacagaacagcgccgtatccccctcgaaacatctctgttcgctttgtcaacttgaacaagaacaactgggaagaaccaagcgggagcttccccgaggactcgttcatcaaaccgcaagacgcgataggaagagacagacccttccatttccccgaggaaacccctgagacgcccgccagcaatgcgtcttccggctggcctgacccgaacggcactgagtatgagagcacatctcagccctactggtgggacagtgcatccgcggcccctgaaaacgaggaggacttcgtcagcgtgctgccagcggactatgacactgaggccacgctcggcaggacagagaaacccacagctgaccctttctctgccttccccgtgcagatgactctgagctggttaccaccaaaaccgcctacagccttcgatggcttcaatatcctcatagagagggaagggaactttaccgactatttgacagtggatgaagaagcccacgagtttgttgccgaactgaaggagcctggaaagtacagactctcagtgacaaccttcagctcctcgggagcctgtgagactcggaaaagccagtcagcaaaatcgctcagcttctacatcagccccacaggagagtggattgaagaactgactgagaaaccgcagcacgtgagtgtccacgtcttaagctcaaccactgccttgttgtcgtggacatcttcccaggagaactacaacagcaccattgtgtctgtggtgtccctgacatgccagaaacagaaagagagccagcggctggagaagcagtattgtacccaggtgaactcaagcaaacctgtaattgagaacctggttcccggtgcccagtaccaggttgtgatgtacctaagaaaaggccctttgattgggccaccttctgatcctgtgacatttgccattgttcccacggggataaaggatttaatgctctatccattgggtcccacggcagtagtgctgagctggacccgaccttacttgggagtgttcagaaaatacgtggttgaaatgttttatttcaaccccaccaccatgacctccgagtggacgacctactacgaaatagcagcgaccgtctccttaacatcgtccgtgagaatagcaaatctattgccggcgtggtactacaactttcgcgtaaccatggtgacgtggggagatccagaactgagctgctgtgacagttccaccatcagcttcataacggcccccgtcgctccagaaatcacgtctgtggagtacttcaacagcctgctgtacatcagctggacctacggggacgccaccactgacctgtcccattcgagaatgctacactggatggtcgtggcagaagggaggaggaaaattaaaaagagtgtgacacgcaatgtcatgacggccatccttagcctgcctccaggagatatctacaacctgtctgtcacagcctgcactgagagggggagtaacacctccatgctccgccttgtcaagctagaaccagctcctccaaaatcactcttcgcagtgaacaaaacgcagacatcggtcaccctgctttgggttgaggagggcgtagctgatttctttgaagtcctctgtcagaagctcgggtctggccacgatggcaaactccaggaaccggtagctgtttcctcccacgtggtgaccatctccagcctcctcccagccactgcctacaactgcagtgtcaccagcttcagccacgacagtcccagtgtccctacgttcatagctgtctccacaatggttacagaggtgaaccctaatgtggtggtgatctcggtgctggccatcctcagcatacttttaattggactgctgttagtgacccttgtcattctgagaaagaagcacctgcagatggccagggagtgtggggctggcacgtttgtcaattttgcatccttggagagggaagggaaactcccctacagttggcgtaggagtgtctttactttcttaaccctgctgccctcatgtctgtggactgactatctgttggcattttatattaacccttggagtaaaaatggcttaaagaagaggaaactgacgaaccctgttcagctggacgattttgattcttacatcaaggacatggccaaggactctgactataaattctctcttcagtttgaggagttgaagttgattggactggatattccacactttgctgcagatcttccgctgaaccgatgtaaaaaccgctatacaaacatcctgccgtacgacttcagcagagtgaggctggtctccatgaatgaagaagaaggagcagactacattaatgccaattatattcctggctacaactcacctcaggagtacattgccacccagggaccactgccggaaaccagaaatgatttctggaagatggtcctgcagcagaagtctcgcatcattgtcatgctcactcagtgcaatgagaaaagaagggtaaaatgcgaccactactggccattcacggaagaacccattgcttatggagacatcaccgtggagatggtctctgaggaagaacaggaggactgggccagcagacacttccggatcaattatgctgacgaggcccaggatgtgatgcactttaactacacggcctggccagaccatggcgtgcctccagcaaatgctgccgagagcatcctgcagttcgtgtacactgtccggcagcaagccaccaagagcaaaggacccatgatcatccactgcagcgcgggcgtgggacggacaggcaccttcatagcccttgacaggctcttgcaacacatccgagatcacgaatttgtggacatcttggggctggtgtcagaaatgcgctcataccgaatgtcgatggtacagacagaggagcagtacatcttcatccatcagtgcgtgcagctgatgtggctgaagaagaagcaacagttctgcatcagtgacgtcatctacgagaacgtcagcaagtcctagttcagactcgggagcggtgaggccatgatgtctacccatcctcccttgcttccagaggttttataggggcctttagtcactttgtcaaatcgcgtccccgctgcgcagtttgtggacaaggaggtgatttaacctcctagaaccgagaagacttagccttaaggagcctacaataccgtttggagtcttttcacttctagacgtttgatggtccaaattcactaggatttccagaaatgctcctcctcgaagggcgggaagtgcccttcctgatggttcagtcggctctttgctgcttgggctgggtttggttttttcttttttttaagtgcaataatttctgtataatcgtgattttttttttacattcgcaattcagaatgttgaattgttatccgcccacatcactgatcagtgccacagccttgggaaggccttatcgcagagttttatctcaccactgaagaggcatggctacacacaggaagactcggtgacaaatcctcaaaggaaatgagcgcgtgtgtccctccctccaacctctcgaagctatgggtcaggagtaggtgggcagagagagaagagaggggttctactcacacgtcagccggtttatctcttcctatttcgaatatgagaacctgtgtttcgaagtagagtaggaaaaacattacttgtctgacttgtcgtagtgggtttcttccttgttgacagttgggagtttcttccgtggctcttttgaactagtgtcactgtcatggtccttttcaaacagccagagctgactcaacagttttgagtctgactctgaactctgagaaatcttggtgcctagccttctttatttttctgtccacccgtgtacacaagaacagtttctccaagagctataggctgtaaaaatgcactttctttccccacccagaggagctgggaattcagaagtcaggacaacgaactcagcatgctaggacagtcactggacaccgtcccttaagaataccgttgagcgtctccgtggattccgacaggatattctctgggttctttgcatttctgttgtcagactcattttaacccgtgtagctagtggcattttattctttggattttgtatgattaaagtacatgattatgtgttgtgaccagcgccgcgaa

SEQ ID NO: 243 - DNA, 452 bp, Rattus rattus
agacaggactgcagtttattgacaccatgacatgacacctgttgtcactggaggagggggtgagtgaaagtggtctccgtggatatcactggggaccccattcgccttttagctagaggtcatggatttagagtgcagatataattctacacactggagtcattaccactcatgccattcctaaacccatcttccatttggtccagctatgaaggcctgggtccctcctctttttgaagggcagagggagcacagggccatccatgtcttaggaacaagaagggctgctggcaatggtggtatatgcctttaatcccagaactcactgtcttaggcaatcagatctctgagttccaggacagccagggctacatagagaaaccatatttgaaaaacaaaatcaaaatagaaagaaagagacaggaaggaaggaagagggggcactggggatg

SEQ ID NO: 244 - DNA, 667 bp, Rattus rattus
ccagtgacagatttatataatttcaatgtaaacttttgctgcagcatggagaccggtcatatctcattggtagatgtacccaaagccctcaaccagggcggtgacagctacacttgcttgaaagaaaattagtccttgccagccgcagcaggatcagatcggtatttctccttgccactgtggacagccacaccagtatgacaagttgacagttcccagtgtcttcaagagcctctctaggctactgccagtggcttctggtctcagagctcattgtgccgagcccttgagaccctgctggacaggtcctgcagatgcttcttcaccttgtagcccagctcctttgtcttctcctccagcaggacgtacttctccttgttgcggctgatgtgctcggggtcaccgatgctctccacgtgcttcagcttctggtgggaaatctccagctgcttctggtagtggttgtgcttttcgattttggcctcgaagtgcttaagctcctccctgaacgactccagttccttctcggtgaagttggcagactgagccaggtcccacagatctatcactcggggctcttcaaactcagtggcggggccgtagccctggtggctgaccttcctcaagcggtctaggccctggttgatactacgcaatctgtccttta

SEQ ID NO: 245 - DNA, 522 bp, Rattus norvegicus
tttttttttttttttttggtgccaatttaaatagttttattattcaatgttacttgttttgggtccctgtggaacaatgctataccctctactttgacttaatcgacctcttcaatggtggggcctgaagaagcaccaccagatggaggagctcctccaccagggacagaagacctcagtgtcactgaggccctctcagataccaaggcaaggcactgaaggaagtattacctccccccatgattttcccccacagctctatctactacttgatggtggtgtaatttgctcagacaccttttgtcttggaggaatcccccagaactgggaaaccccatcttgtactaactgtagcctcaaagtttggctattgtggtgagggacctgccctttctctgcacctcactgatgatgtttcaaacaacctccacagtgaaagcaatctaagcttcctcatgaagcactcagctgcatgaagtgaccgaacttcctgaaaataagctctagactgactgactctac

SEQ ID NO: 246 - DNA, 1318 bp, Rattus norvegicus
cgccgcccaggctagcgcgagcctccgctccatcgccccgccgccatggacctattcggggacttgccggagcccgagcgcccgccgcggccgtctgccgggaaagaagcacaggaaggacccgtgctcttcgaggacctgcccccgaccagcagtactgactcaggatctgggggacctttactctttgatggtcttccacctgctggcagcggcaattcaggttctcttgccacatcaggctcccaggtggtgaagaacgaaggaaaaggagcaaagaggaaagcccctgaggaagagaagaatggcggtgaagagcttgtggaaaagaaagtttgtaaagcctcttcggtgatctttggtttgaaaggctacgtggcagagcggaagggtgagagggaggagatgcaggacgcccatgtcatcctgaatgatatcactcaggagtgtaatcctccatcatctctcattactcgggtttcatactttgctgtttttgatggacatggaggaattcgagcctcgaaatttgctgcacagaatttgcaccagaacttaatcaggaaatttcctaaaggagatgtaatcagtgtggagaagactgtgaagaggtgcctgctagatacttttaagcacaccgatgaagagttcctgaaacaggcttcaagccagaagcctgcctggaaagacgggtccactgccacgtgtgtcctggctgtggacaacatcctgtatatcgccaaccttggagatagtcgggcaatcctgtgtcgatataacgaggaaagtcaaaagcatgcagccttaagcctcagcaaagagcacaatccaactcagtatgaagagcgcatgaggatacagaaggctggaggcaatgtcagagatggccgtgtcttgggtgtgctggaggtatcccgctccattggagatgggcagtacaagcgttgcggggtcacatccgtgcctgatatcagacgctgccagttgacccccaatgacaggttcattttgctggcttgtgatgggctcttcaaggtctttaccccagaagaagctgtgaacttcatcttgtcctgccttgaggatgagaagatccagacccgagaagggaagcctgctgttgatgcccgctatgaagctgcatgcaacaggctggctaacaaggcagtgcagcggggctcggcagataacgtgacggtgatggtggtgaggataggacactgaggccgcacactgcacgtgtgctcttgacttgcaggttcatcttgtttgtgcacgctgtgtgtactcctgtggggcttctatggttgtaaataaa

SEQ ID NO: 247 - DNA, 485 bp, Rattus norvegicus
tttttttttttttttttaatggttaaggactgctttattggtggcagttaatacacatcaataaatattgatccccatagaagagttcagttattcatcaggttcctggtccatcgcgcagtgaatgaaactgaaccatgtggagactgggatgacgatgtcagttctgcttcttggggaatgcagccatagctaacatatagatggcatacgctgttccaccaactgtcagaagcattgtggctctgtaaaggagggcatcagatgtcccgcctttcagatgaactggcatcccattatcctcctgaaacagcttttgcttctctggaactttgttttcaaaatgccttcgtgaagtggtgctgatggtcctctgggcaatctgacgaagggccagcacattccgcagcatcttagctcagttgttacccaccaaccgcgactactgaacgccaaaaatcgaaaacccctcgtgccgaattctt

SEQ ID NO: 248 - DNA, 437 bp, Rattus norvegicus
  misc_feature (387)..(387): n is a, c, g, or t
  misc_feature (416)..(416): n is a, c, g, or t
ttttttttttttttgttgttgatctatttttgctacacagcgtttattgaacaccgtttaataaaaatagagtaaattacaatgtgctgtggaaggttggagcttgctgctgggaagctgatgccagaagaggccgtgaacttggggatatgggctctttaaaggcagagagattatggctgggggtttgggggctggggtgcagacaacccagagccacttcctgtacaccctcacatgaggtgctctctggaaggagcgccaaaccctgggcaccagggtcaagaggtaagcagccagctgtctgaacacggtgattctgagacatggatagttagatatggtcacctactgacaagccaccaaaggctcctattctagacctcnctggggtatgctttagattgacgccctgngtgtatctgactaaaaatcaa

SEQ ID NO: 249 - DNA, 620 bp, Rattus rattus
acttcttctcaaatccagttttattaaagtcgtttggcaattttggtggcagcttaaggtggtggcacacattacacatgagtttcagtttttatttgcaggaggtctggatacatgcacatttctggccccactgctgttcactaccaaacaccaaactgctatctgcatccctagtctccacagcataggaatttgtcaaacagggttgaaaaaactgaaaaccaagatttaaaaaaattcttgtcaaacattaagaacatacaaagtaaattaaagatttccacacttagacttccaggtatgaaaacagacatgtgatagcttgtggtttcttcatttttacttattgattattagagttcagagaccagaagtgtttcctaaggttgaaaaaaaccccactgagaactcccaatagaatttccatggagttagaagacagaagaactgggagcaaggtgatttggctattaaaaatcaagtgactttttctttagtgggatttttctcctgcatagctcaggggatggtttgcttccttagtatacacactgagcatggacttattaaaatgtataactggacagcaaatgatgggtggcctctcttatccaagg

SEQ ID NO: 250 - DNA, 2775 bp, Rattus norvegicus
ctcttctgctcaagatggttgcgtcccgggcaattggcagtctcagtcgcttctctgccttcaggatcctgcgctccagaggctgcatttgcacagctttacaacttcttcctgctttgctgtctagaacccatattaattatggagtcaaaggggatgtggcagttattcggattaactcgcccaattcaaaggtaaatacattgaataaagaagtacaatcagagttcgtagaagtaatgaacgaaatctgggccaacgaccaaatcaggagcgccgtccttatttcgtcaaagcctggctgctttgttgcaggtgctgacatcaacatgctggcctcttgtacaacgccccaagaagcagcacgaatatcacaagaaggacagaaaatgtttgagaaacttgaaaagtcaccaaagcctgttgttgccgccatcagtggatcctgcttgggaggcggacttgagcttgccatagcatgtcaatacagaatagcaacaaaagacagaaaaacagtattaggtgtccctgaagtgttgctgggaatcttaccaggagccggaggtacccagaggctgcccaaaatggtgggtgtgcctgctgcttttgacatgatgctgactggtaggaacattcgtgcagacagagcaaagaaaatgggactggttgaccagttggtggacccgctaggaccaggaataaaatctccagaggaaaggacaattgaatacctagaagaagttgcagttaattttgccaaaggcctggctgacaggaaggtctctgcaaagcagagcaaaggcctgatggaaaagctgacatcgtatgccatgactatcccactttgtctgactacaacattcaaaacagtggaagaaaaagtgaagaagcagaccaaaggcctttaccctgcacctttgaagataattgacgctgtgaagactggacttgagcaaggaaatgatgctggctatcttgccgaatcagagaaatttggagagcttgcattgaccaaagaatcaaaagccctgatggggctttataatggccaggtcctgtgcaagaaaaataaatttggagcgccacagaagactgttcagcagctagccatccttggcgcagggctgatgggggctggcattgcccaggtctctgtggacaagggactgaaaactcttcttaaagacactacagtgacagggctgggccggggacagcaacaagtgttcaaaggactgaatgacaaggtaaagaagaaggcactcacatccttcgaaagggactccatcttcagcaacctgatcgggcagctcgactacaagggcttcgagaaggctgacatggtgattgaggctgtcttcgaggacctcgctgttaagcacaaagtgttaaaggaagtggaaagcgtgactccagaacactgtatcttcgccagcaacacatctgctctcccaatcaatcaaattgctgctgtgagccaaaggcctgagaaggtgatcggcatgcactacttctctcctgtggacaagatgcagcttctagagatcatcacaactgacaaaacctccaaggacaccacagcgtctgccgtggccgtgggtctcaagcaggggaaggtcatcattgtggtcaaggacggacctggcttctacaccaccaggtgtcttgctcccatgatgtcagaagtcataagaatcctccaggaaggagttgaccctaagaagctggacgccttgaccacaggcttcggcttccctgtgggtgctgccaccctggcagatgaagtagggatagatgtagcacagcacgtagcagaagatctaggcaaagccttcggggagcggtttggaggtggcagcgtagaactgctgaaactgatggtctccaagggcttcttgggtcgcaagtctgggaagggcttctacatctatcagtcgggctcaaagaataagaatttgaattctgaaatagataatatcttggtaaacctgaggctgcctgccaagcccgaggtctcctctgatgaagacatccagtaccgtgtgataacaaggtttgtgaatgaggcagtcctgtgcctacaggaagggatcctagccacgcctgaagagggagacatcggagcagtctttgggcttggctttcccccttgtctcggagggcccttccgctttgtggatctgtatggtgctcagaaggtagtggaccggctccggaagtatgagtctgcctatgggacacagtttaccccgtgtcagctactccgcgaccttgctaacaactctagcaagaagttctaccagtgagcaggccgtcccgccctgcccctccacccacgtactaacccagacccggcagtgctgcttctcagccgcgctgtctaaattatcaggaagcaggagaaagaccgaggctagccttggatttgctcctccatgatagtgccttcagccctgtcccgctcttcctcctggtgaagtctgactgtgaattaaatgtttgtacttcatgttggggggtgagccccactgtgcttcttttgcaagccctgcctgagaccccgatcagcagcctagagtaacccagaacacctgctgcctgtgccttccgggaggccagtggggcctggggtgccgagggcattttcgcaccaagccaaacacaggataacattaaaatccagactgtcggcctctgccagcctggtctgttttcctctgcctgcccttgtgtttgagcacccccatcagtaataaagccctgtgctctgagcat

SEQ ID NO: 251 - DNA, 711 bp, Rattus norvegicus
acctctgatttccaggacagccagcactcagttccacaggagccacaacgcacactgggaaacatgggtctgaagctgctcgagtccagactttgtctccttctgtcgctgggacttgtcttgatgcttgcctcatgccagccaccaaccccttcccagtggtttgaaatccagcacatctataatagggcttatccccgatgtaatgatgcaatgcgacacagaaacagattcacaggacattgtaaggacataaatacttttcttcatacaagttttgctagtgttgttggtgtgtgtggcaatagaaacatcccctgtggaaacaggacatatagaaattgtcataacagtcgatatcgggtatctataactttctgtaacctcacaactccggcaaggatttatacccaatgtagataccaaactacaagatccaggaagttctacacagttggctgtgacccgaggactccacgggacagtcccatgtatccagtggttccggttcacttggataggatattttagctccggtgccagcactttgtacctgagctcatcggctcctgccaagatcacagtagtgaagatccagttcctctgtctgcactgcatatcagctcctgtcctcatgaaacctgtccctgactccttttagtatagcttaacagatttttgtaatcaataaacacctttgcatatgcatct

SEQ ID NO: 252 - DNA, 1458 bp, Rattus rattus
gagggtttaggctggtctccggtgacctcctagtcctaaatcttgatacccttgcaagagctttgagcgtgtggggtcccgggcgttcggggtcccgggtgtgtgcggtttgtatagcctgaagccggggtcctccgcgctcgcgtcctccgcagctggactgaagagacgcgtcccagccctgcggggatggaacggaccgagctgctgaagccccggaccctggccgacctcatccgaatcttgcatgagctcttcgccggggacgaagtcaatgtggaggaggtgcaggctgtgctggaagcctacgagagcaatcctgccgagtgggctttgtatgccaaattcgatcaatacaggtatacccgaaaccttgtggatcaaggaaatgggaagtttaatctgatgattctgtgctggggtgaagggcatggcagcagtattcacgatcacacggactcccactgctttttgaagctgctgcaaggaaatctaaaggagacattgtttgactggcctgacaagaaatccaacgagatgatcaagaagtctgaaagaactttgagggaaaatcagtgtgcctacattaatgattctattggcttacatcgagtagagaacgtcagccacacagagcctgctgtgagccttcacttgtacagtccacctttcgatacatgccatgcctttgaccaacgaacagggcataaaaacaaagtcaccatgacattccacagcaaatttggaatcagaactccatttacaacttcaggttcactggagaacaactaagacctgccaagcctttcaaagttttgcttctgggtcgttggaatgttttaccttggataagagaggccacccatcatttgctgtccagttatacattttaataagtccatgctcagtgtgtatactaaggaagcaaaccatcccctgagctatgcaggagaaaaatcccactaaagaaaaagtcacttgatttttaatagccaaatcaccttgctcccagttcttctgtcttctaactccatggaaattctattgggagttctcagtggggttttttttcaaccttaggaaagcacttctggtctctgaactctaataatcaataagtaaaaatgaagaaaccacaagctatcacatgtctgttttcatacctggaagtctaagtgtggaaatctttaatttactttgtatgttcttaatgtttgacaagaatttttttaaatcttggttttcagttttttcaaccctgtttgacaaattcctatgctgtggagactagggatgcagatagcagtttggtgtttggtagtgaacagcagtggggccagaaatgtgcatgtatccagacctcctgcaaataaaaactgaaactcatgtgtaatgtgtgccaccaccttaagctgccaccaaaattgccaaacgactttaataaaactggatttgaga

SEQ ID NO: 253 - DNA, 1102 bp, Rattus norvegicus
gcaacgcgggtcttcccgctgttgctgtcggggccacggccgagcacacgaccccggcctgaggtggtggtgggaagcccgccgctgtttgctgcgacctcatggagggtggcggaggaagtagcaacaaatccaccggcgggttagcgggcttcttcggagcgggaggagcgggttactcgaacgctgatttggccggcgtcccgctgactggtatgaaccccctgtctccttacttaaatgtggacccacgctatctcgttcaggatacagatgagtttattttgccaactggagctaataaaacccgaggcaggtttgaactagctttcttcaccattggaggatgctgcatgacaggggctgcattcggggcactgaacgggcttcgtttaggattgaaggaaactcagagcatgccctggtccaaaccaagaaatgtacagattttgaatatggtgactagacaaggggcactttgggctaatactctaggttccctggctttgctctatagtgcttttggcgttatcattgagaaaacacggggtgcagaagacgacttcaacacagtagcagctggaaccatgacaggaatgttatataaatgtacaggtggtcttcgaggaatagcacgtggtggcctggcgggactgacactgaccagtgtctatgcactgtataacaactgggagcacatgaaaggttccctgctccaacagtcactctgaagatgtctgccacctcaggaatgggggacacttcatagtcatccagatcaaggaataagtcagtctggagctgctttctctcttgcacctacaattactttgaacaattggagactctgatttgctgtgacaaagatcatggatgcttagcctggactgcactgcttgccctctgagtggaagccaaacccttggtggctcactgagaatgtgttctcttctcctttggagatgacctcgcacctcctgcccccaaactggaaaaccacttactctccaaatttattaccatgttaattcatttaaaaatctaaaacttaatattgccctgttttccaaataaagggtgaaaatacaaccaaagctaaaag

SEQ ID NO: 254 - DNA, 2401 bp, Rattus norvegicus
caacatgggggactctcacgaagacaccagtgccaccatgcctgaggccgtggctgaagaagtgtctctattcagcacgacggacatggttctgttttctctcatcgtgggggtcctgacctactggttcatctttagaaagaagaaagaagagataccggagttcagcaagatccaaacaacggccccacccgtcaaagagagcagcttcgtggaaaagatgaagaaaacgggaaggaacattatcgtattctatggctcccagacgggaaccgctgaggagtttgccaaccggctgtccaaggatgcccaccgctacgggatgcggggcatgtccgcagaccctgaagagtatgacttggccgacctgagcagcctgcctgagatcgacaagtccctggtagtcttctgcatggccacatacggagagggcgaccccacggacaatgcgcaggacttctatgactggctgcaggagactgacgtggacctcactggggtcaagtttgctgtatttggtcttgggaacaagacctatgagcacttcaatgccatgggcaagtatgtggaccagaggctggagcagcttggcgcccagcgcatctttgagttgggccttggtgatgatgacgggaacttggaagaggatttcatcacgtggagggagcagttctggccagctgtgtgcgagttctttggggtagaagccactggggaggagtcgagcattcgccagtatgagctcgtggtccacgaagacatggacgtagccaaggtgtacacgggtgagatgggccgtctgaagagctacgagaaccagaaaccccccttcgatgctaagaatccattcctggctgctgtcaccgccaaccggaagctgaaccaaggcactgagcggcatctaatgcacctggagttggacatctcagactccaagatcaggtatgaatctggagatcacgtggctgtgtacccagccaatgactcagccctggtcaaccagattggggagatcctgggagctgacctggatgtcatcatgtctctaaacaatctcgatgaggagtcaaacaagaagcatccgttcccctgccccaccacctaccgcacggccctcacctactacctggacatcactaacccgccacgcaccaatgtgctctacgaactggcacagtacgcctcagagccctcggagcaggagcacctgcacaagatggcgtcatcctcaggcgagggcaaggagctgtacctgagctgggtggtggaagcccggaggcacatcctagccatcctccaagactacccatcactgcggccacccatcgaccacctgtgtgagctgctgccacgcctgcaggcccgatactactccattgcctcatcctccaaggtccaccccaactccgtgcacatctgtgccgtggccgtggagtacgaagcgaagtctggccgagtgaacaagggggtggccactagctggcttcgggccaaggaaccagcaggcgagaatggcggccgcgccctggtacccatgttcgtgcgcaaatctcagttccgcttgcctttcaagtccaccacacctgtcatcatggtgggccccggcactgggattgcccctttcatgggcttcatccaggaacgagcttggcttcgagagcaaggcaaggaggtgggagagacgctgctatactatggctgccggcgctcggatgaggactatctgtaccgtgaagagctagcccgcttccacaaggacggtgccctcacgcagcttaatgtggccttttcccgggagcaggcccacaaggtctatgtccagcaccttctgaagagagacagggaacacctgtggaagctgatccacgagggcggtgcccacatctatgtgtgcggggatgctcgaaatatggccaaagatgtgcaaaacacattctatgacattgtggctgagttcgggcccatggagcacacccaggctgtggactatgttaagaagctgatgaccaagggccgctactcactagatgtgtggagctaggagctaccaccctcccacccctcgctccctgtaatcacctaacttctgccgacctccacctctggtggttcctgcctggcctggacacagggaggcccagggactgactcctcctggcctgagtggtgccctcctgggcccctaggcagagcccggtccattgtatcaggcagcccagccccagggcacatggcaagagggactggacccacctttgggtgatgggtgccttaggtcctctgcagctgtacagaaggggctcttctctccacagagctggggtgcagcccccacacgtgattttgaatgagtgtaaataattttaaataacctggcccttggaataaagttgttttcagt

SEQ ID NO: 255 - DNA, 1634 bp, Rattus norvegicus
cacagtcatggctgcggtggcggtggctgttcgcgaagaatcgagatccgagatgaagacagaactttcacctcggcccggggcagcggggcgggagttgacccaagaagagaagcttcagcttcggaaagaaaagaaacagcagaagaagaaacggaaggaggaaaagggggcagaccaagaaattggctctgctgtatctgcagctcaacgtcaagacccagtcagagaacttcaaggaactggtagtcagttgggaggcactactggggagaaacttccagctggccggagtaaggcagaacttcgagcagaaaggagagccaagcaggaggcagagcgggccctgaaacaggccagaaaaggggaacaaggaggaccctctcctcaggcctgccccagcacagctggagaagccacctcaggagtgaagcgtgtccctgagcacacccaggctgatgaccccacacttctgaggaggctccttagaaagccagatcgacaacaggttcctacaagaaaggattatggatccaaagtcagtctcttctcccacctaccccagtacagcagacaaagctccttaacccagtacatgagcatcccatcctctgtgatccacccagccatggtgcgactcggtctgcagtactcccagggccttgtcagtggctccaatgcccggtgcatagcgctgctccacgctctgcagcaggtgattcaggattacacaacacctcccaatgaggaactctccagggatcttgtaaataaactaaaaccctacatcagcttcctgacccagtgccgccccatgtcggccagcatgtgtaacgccatcaagttctttaacaaggaagtcactggtatgagcagctccaagcgggaagaagaggccaagtcagaacttaaagaagccatcgatcggtatgtgcaagagaagattgtgcttgcatctcaggcaatttcacgatttgcttctaagaagatcagtgatggggacgtgatcctagtatatggatgctcatctctggtgtcgagaattctccaggaggcctgggttgagggcaggcgcttccgggtggtggtggtagacagccggccccggctggagggaaggcatatgctccactgtctggtccgtgctggggtccctacctcctatctgctgattcctgcggcctcctatgtgctcccagaggtttctaaggtgctattgggagctcatgcactcctggccaatggatctgtgatgtcgagggtagggacagcacagttggccctggtggcccgagctcataatgttccagtactggtctgctgtgaaacatacaagttctgtgaacgcgtgcagaccgatgcctttgtctccaacgagctagatgaccctgacgatctccagtgtaagcggggagaccaggtgaccctggcgaactggcagaacaactcatcactccggttgttgaatctggtctatgacgtgactccccccgagcttgtggatctggtgatcacagagttgggcatgatcccttgcagttctgtgcctgttgtcctccgagtcaagagtagtgaccaatgaaaggcatcaagggtcaataaaaaacttattccttactgccataaaaaaaaaa

SEQ ID NO: 256 - DNA, 2289 bp, Rattus norvegicus
acaatataagacagaggaaaattttaagacatgactgaatcgaaggcttaccgatttggagcagttctgcttcttatccacttaattttccttgtccctggaaccgaagcagcttccttccagcgaaaccagctgcttcagaaagaaccagacctcagattggagaatgtccagaagtttcctagtccagaaatgatcagggctttggagtacatagaaaagctcaggcagcaggcccacagagaagaaagcagcccagactacaatccctaccaaggcatctctgttccccttcaactcaaagaaaacggagaagaaagtcacttggcagagagctcaagggatgtcctgagtgaagacgagtggatgcggataatacttgaggctttgaggcaggctgaaaatgagccgccatctgccctcaaggagaacaagccctatgccttgaatctggagaagaacttccctgtggacacgcctgatgactatgagactcaacaatggcctgagaggaaactcaagcacatgcggttccctctcatgtatgaagagaattccagggaaaaccccttcaaacgcacaaacgaaatagtagaagaacagtacacaccccaaagtcttgctaccctggagtctgtgttccaagagcttgggaaactgacagggccaagcaaccagaagcgtgagagggttgacgaggaacagaagctctacacggacgatgaagatgacgtgtacaagaccaacaacattgcctatgaagatgtggtcgggggagaagactggagtcctatggaggagaaaatagagactcaaacccaggaagaggtgagagacagcaaagagaacacagaaaaaaacgaacaaatcaatgaagagatgaaacggtcagggcacttggggctcccagatgaaggtaaccggaaagagagcaaagaccagctctcagaggacgcctccaaggtcatcacctacttgagaaggttagtgaatgctgtgggcagtgggaggtcccagagtgggcaaaacggggacagggcagccaggcttcttgagaggccccttgattctcagtctatttatcagctgattgaaatctccaggaatttgcagataccccctgaagacttaattgagatgctcaaagctggggagaaaccaaatgggttggtggagcccgagcaggatctggagcttgctgttgacctagatgacatcccggaagctgacatagaccgcccagacatgtttcaaagtaagacgctctccaagggtgggtatcccaaggcacctggtcgaggtatgatggaggccttgccagatggcctcagtgttgaagacattttaaatgttttagggatggagaatgtagcaaatcagaagtccccatatttccccaaccaatacagccgagacaaggctctgctgaggcttccttatggtcctgggaaatctagagccaaccagattcccaaagtagcctggatcccagacgttgaaagcagacaagccccctatgacaatctgaatgataaggaccaagaattgggagagtacttagccaggatgctagttaagtaccctgagctcatgaataccaaccagctgaagagagtgcccagcccaggctcctcagaagatgacctccaagaagaagagcagctcgagcaggccatcaaggagcatctgggtcaaggaagctcccaggaaatggagaaactggccaaggtgagcaaaaggatccctgcaggatccctgaagaatgaggataccccaaatagacagtacctggatgaagatatgctcctgaaagtgctagagtatctcaatcaagaacaggcagagcagggaagggaacatcttgccaaacgggccatggaaaacatgtaaacagctttaatgcccaatttcccttcttttccccaagtgaatcccctccctttctcttaagtgtgttaatctctatcctgttaacactgtaatatctttaagtgatgtacaagcagatgactccagatagttttggggatctgctttacttattctgagctgttatgttgtgtatggatgtgtataaatgttatgactctcagattaaaaatatgtcctttattcaagaaagatatctatgatagtgttgactaatgtatccaatggtcatggtattgacaatgctcacatatgatgaagagtatcctataattatcttggaagtttttaacatttattgaattattttgttactgtctgtagtgttttgtggagttctggagcaaaatcaataaagca

SEQ ID NO: 257 - DNA, 3298 bp, Rattus norvegicus
cggcaccatgagcaaacgcaaggccccgcaggagaccctcaacggcggcatcacggacatgctcgtggaactcgcaaactttgagaagaacgtgagccaggcgatccacaagtacaatgcatacagaaaagcagcatctgtgatagcaaagtacccacacaaaatcaagagtggagcagaagctaagaaattgccaggagtaggaacaaaaattgctgaaaagattgatgaatttttagcaactggaaaattgcgtaaactggaaaagattcgtcaggatgatacaagttcatccatcaacttcctgactcgagttactggcatcgggccatctgctgcaaggaagcttgtagatgaaggaattaaaacattagaagatctcaggaaaaatgaagataaattgaaccaccatcagcgaattgggctgaaatattttgaggactttgaaaagagaattcctcgtgaggagatgctgcaaatgcaggacattgttcttaatgaagttaaaaagctggatcccgagtacatcgctacagtctgcggcagtttccgaagaggcgcagagtccagtggagatatggacgttctgctgacccacccaaacttcacgtcagaatcaagcaaacagccaaagttgttacatcgtgttgtggaacagttacaaaaagtccgtttcattacagatactcgttcaaagggtgagacaaagttcatgggtgtttgccagcttcccagcgagaatgatgaaaacgaatatccacacaggagaatcgatatcaggttgatccccaaagatcagtactactgtggtgttctctacttcactggaagtgacatctttaataagaatatgagagcgcatgccctggaaaagggcttcacaatcaatgagtacaccatccgccccctgggggtcactggggttgctggggagccccttccggtggacagcgagcaggacattttcgattacatccagtggcgctaccgggagcccaaggacaggagtgaatgacgcctgccccacccaggcctatcccacgaggagtcctaagttattgcttaacctttgctatgtaagggttgggtgttttaggtgattgcctcttctctgtgcttcccatggactatcgtcaatgaacctcttgagcagctattcagtattttcttagcacatgtgtttaaacttagatatgtttgtgatcgcagtaccatggtttactagagaaacgtaagagccgatgtgataagcagtgtttaatgacctttcacttccacctcacattgcagccacagtcggccccacttgtccctatccaccctttatgggtcagctggtctcccagagccatctccagaagtcacttcattatccttagaaacaaggggcttccaggcatggtggtgcacatccttaatcccaggacttgggaggcagagacaggcagatctctgtgagttcaaggccagcccagactacatactgaattcagggtgccagagctacatagtgaggccctatctaaaaagaaaggggccttcatagctgtaagacttctgtgaccatttcccatttgcagtgtatactgataactagaagacagtgtgtgctttacctcaggggcagccttcccctcacagctcaatggcacctaactagcattcatcagtcgtctggtggacagtccactgtttatcaaataacattctgtgacacgaacaaagaacttcaagtttaagaaagatttatttgagcagattgagccactgtgtctggatggctttattgtagagtcctgtcatgttgtagatggtagtcacaaagtcagaagtaactcatcacagcgtctggtcactgtcagttgctagaagattcagctttatttatgtgctgggtataatgtacttgcctgtaatcccaagactcactcgaggcaagaggaacatgagttcgaagcccaccctgggctatatagcttactctgagaccctgtctcagaacccttacccctccccccaaaaattatccaggaggcagaggcaggtgggtctctatgagtgtaaggccagccagggctacacagcgagaccactgtctcagaaaacaaaataaaaaatagaataaaattagtgccagggattctgtgtgaacacgagggacaagtcccatgtctgtacaacttatattctttggcatactcttagccttgtatgttgtcggttaccagtcacctgacttcgacaggacagtccagggaccacagtcacagcgctggaagatttctggggcttgggcagtgtctttgtgccccctcctggaacacacttgtccctctagtagaactggcttgcaaattttggtccaaaaatggcgagcacagcaaagtccagggccgcagtcggaggttctgagacagctttctccctcctgtcctgtaacaaggtaggctcaggctctagaggtggcagatgggttaagggtgtgtgtgtgtgtgtgtgtgtgtgtgtgtgtgtgtgtgtgttatactaatgggttgagattgggatctaggaatgaaggcctatatagcctatatataaactagcaaagccaacaggacacaggtctcacagaataagggaaattagagccctactgaacaaagacatcaaggaatgattatctaccctgagaaataggtagcactccacaaagtttgctaatacagtttttcgtgagcatcgattcctttacttataaaggggccagctagtccaatatgtgagtaggagcggctgttgtacctctccactttcaaatactctgttattcaagactttaactcgagactcctatttttgtttaaaagaatttttgtaaatccccaagtgtggtggcagacacctttaatcccagcagaagccgtcgggtctctgagttcctgaacagtctggtctacacagtgagttctaggatagcagagctacagacccttttgtactatgtacaagtctggagtgaatgcatcttctttaatccactctgtatgctgaggctataggaaaggtacgtggcacttggtacaccccagcttagggaaagccatcggttggaggtttccttcctaagctgtcatcactagggtcttgccctggcctggccaatagagtcccttgaattgctccaagagctcacagacatgaggtaaaggagtttagcttcagcctgtggggctgggagggagaaaatggtttttaaaataaaatatgctctccttaaaaaaaaaaaaaaaaaaaaaaaaaaaaaaaaaaaaaaaaa

SEQ ID NO: 258 - DNA, 530 bp, Rattus norvegicus
tttttttttttttttttcacacaaacacagagtgtatttttattacgtaaaacgttgcattggtgagcaacaattatttgtgtggagagctcagaaaggcacggcgaccagttgcctcattcatgattgcagccacgattttgcaccttccttctagtgggtcctgaagtctaagtggcagttaagcttgtaaatcctgtcggtttctattcaatcacaggaaagagtgcaggatgggcagtactctcttcagaatttacatctttagaacagttcgaatgctgtttcccgagtgcatcagatcaaaggctttgttaatctggtcgaaggacagattgccagtcacaaattcgtcaacttttacctttttggacatatattcagacaccagcttcgggacactctccacactcttccagcctccaaaggcagtgcctttccacgtgcgtcctgtcaccagttggaacggacgattggagatttcttcacctgaagcggccacaccaacatcagaatggtaaccctcgtgc

SEQ ID NO: 259 - DNA, 5761 bp, Rattus norvegicus
ggctccgggcggctgcggcgcaggccgagcgcaccaagtgacgggtcgagcaaaggaccgacgcgcgggtggacgctgcgaagcgcctcattccagagcccgacatgaatggatatgtggacttttccccaagtcccaccagccccacccaagagccaggggagcctcaacccacccaggctgtgctccaggaagacgtggacatgagcagcggctccagcggaaatgaaaactgctccacggggcgggactctcagggcagtgactgtgacgacagtggaaaggagctgcggatgttagtggaatcgtccaacactcaccccagccctgacgataccttcagactcatgatgacagaggcggagcataacccctccacaagcggctgcagtagtgagcagtctgccaaagctgacgcacacaaagagctgataaggaccctgagggagctgaaggtccacctccctgcagacaagaaggccaaggggaaggccagcacgctggcaaccttgaagtacgctctgcggagcgtgaagcaggtgaaggctaatgaggagtactaccagctgctaatgtccagtgagagccagccctgcagcgtggatgtgccttcctacaccatggagcaggttgagggcattacctccgagtatattgtgaagaactcggacatgtttgctgtggctgtgtccctggtctctgggaagatcctgtacatctccaaccaagtcgcccccatctttcactgtaagaaggacgccttcagtgatgccaagtttgtggagttcctggctccccatgacgtcagtgtgttccacagctacaccaccccttacaagcttccgccctggagtgtgagcagtggcttagattctttcactcaggagtgcatggaggagaaatcttttttctgccgtgtcagtgttgggaaacaccacgagaatgagattcgctaccagcccttccgcatgacaccctacctggtcaaggtgcaagagcagaagggcgctgcgagccagctctgctgcctgctgctagcagagagggtacactcaggctatgaagctcctagaattcctcccgagaagagaattttcacaacaacccacacaccaaactgcctgttccaggatgtggacgaaagggcggtccccctcctgggctatctacctcaggatctgatcgagacccctgtgctcgtgcagctccaccccagcgaccggcccttgatgctcgccatccacaagaagatcctacaggccagtgggcagcctttcgattattctcccattcgattccgcacacgcaacggggagtacatcacactggacactagctggtccagcttcatcaacccgtggagcaggaagatatccttcatcatcgggaggcacaaagtcagggtaggccctttgaatgaggatgtgttcgcagcctccccttgcccagaggagaagactccgcaccccagcgttcaggagctcacagagcaaatccaccggctactgatgcaacctgtcccccacagcggctccagtggctatgggagcctgggcagtaacggatcccacgaacacctcatgagccagacatcatccagcgacagcaatggtcaagaggagtctcactggaggagatccggaatttttaaaaccagtggcaagagtcaaagcaaaagtcacttttctcctgagtctggaggacaaaaggaagcctctgttgcagaaatgcaaagtagtcctccagctcaggtgaggtctgtcaccaccatggaaagggacagctcgggggccagcctacccaaggctagctttccagaggaactaacctataagagccagcctccttgctcctaccagcagatcagctgcctggacagtgtcatcaggtacctggagagctgcaacgaggcagccaccctgaaaagaaagtgcgagttcccagccaacatcccatcccggaaggccacggtcagccctgggctgcactctggagaggcagcgcggtcctccaaggtgaccagccacacggaggtcagtgctcacttgagctccttggcgttgccgggcaaggccgagagtgtggtgtccctcaccagccagtgcagctacagcagcaccatcgtgcacgtgggcgacaaaaagccacagcctgaactagagacagtagaagatgtggccagtgggcctgagtcccaggatgatgcagctggtggcctcagccaagaaaaggggtctctgcagaagctaggcctcaccaaggaagttctggctgcacatacccagagagaggaacagggcttcctgcagaggttcagggaagtgagcaggctcggtgccctgcaggctcactgccagaactatctccaggagcggtcccgagccccagcaagtgatcgaggactaagaaatgcttctggaatagaatcatcttggaaaaaaactggaaagaacaggaaactgaagtccaagcgtgtcaagactcgagactcttctgagagcacagggtctgggggacccgtgtcccaccgacctcccctcgtgggcctgaatgccacagcctggtcgccctctgacacatcccagtctagctgtccctctgcaccattccctgctccagtgccagcttacccactacctgtgttcccggcacctggaatagtatccacaccagggacggtggtggcaccacctgcagccgcccacaccggcttcaccatgcctgttgtgcctatgggcacccagcctgaattcgcagtgcagcccctgccgttcgctgcccccttggctccggtcatggccttcatgctacccagctacccgtttccaccagcaaccccaaacctgcctcaggccttcttccccagccagcctcactttccggcccatcccacacttgcctctgaaataactcctgcctcccaggctgagttccctagtcggacctcgatgctcaggcagccatgtgcttgcccagtcacccccccggctggcacagtggccttgggcagagcctccccgccactcttccagtcccgaggcagcagtcccctacagcttaacctgcttcagctagaggaagcacctgaaagtagtactggagctgcagggaccttggggaccacggggacagcagcttctggtctggactgcacatctggcgcatctcgggaccggcagccaaaggcacctccaacatgcagtgagccctcagacacccagaacagtgatgccatctccacctccagtgacctgctcaacctcctcctgggcgaggacctctgctcagccaccggctcagcactgtcgagaagcggggcatctgccacctcagactcactgggctccagctccctgggctgtgacacatcccggagtggggcaggcagcagtgatacaagtcacaccagcaaatactttggaagcattgactcttcagagaataatcacaaagcaaaaatgatcacagacacggaggagagtgaacagttcattaagtacgtcttgcaggaccccatctggctgctgatggccaacacagacgacaatatcatgatgacataccagctgccctcccgggatctccaggcggtcttgaaagaggaccaggagaagctgaagctgctgcagaggtcccagccccacttcacggagggccagaggcgagagcttcgagaggttcatccgtgggtccacaccgggggtctgcctaccgccatcgacgtaacagggtgtgtttactgtgaaagtgaggagaaaggcaacctttgtctgccatatgaggaagacagtccttccctgggactctgtgatacctcagaagccaaagaggaggagagcggacagctggccaatcctaggaaggaggcccagacgtaaccccgtccccggctagaagtctacattagacggtgctcggaagaggtggaagagcttgtgtttctaacgaaatggacccataccttcactgcttcttttgttttagaaaaaaaaaacaaaacaccatagttttctgaaggtggaacagagctgtggggaggtttaggaggaaatacgtttttgtattaaaatagaaatatggaatttgggggatggggtgagattcgtcattggacttgaggagactgagaccatctgtgtgtcatctggaggtcagaagtccctgacctccatgagacctctttccagtgtaccagtgtcctcttacccctggggattgtcctgaaacatcaggatgtttcagatcaccaggatgtgacatataacggggaagccacatgaggctcagccaagggcctgctttctggaactttcccatggtgtggttgtatcagatcctatctcccaagcagagagaccacccctcctgacatcctctcagtgcgttcccttatgtggtttggagcatggtgtggcagcttttgcttcaggtcctgtggtggccagcattccagtcggacctggcttcagttcatcaacagagttgaaatgcctactctggactgatggagcttagtggtgtctgtgaccgatgccatcagactagcacccacactgtacgtttctgtgccgttcttggatcctttttagaccatcatggccagtgtgcagagagagctgtggcttcagccatgtcaccctgtctgtttggtggcctctgcaagccaagctttgttgctgctggggacgcggtcatatatttgttctttggttggactctcagatttcagcttccagcagaaagcagccactgaacatggggagagggcacccacactgtcaccctgagctcttcagtttgcagggagctcagcctcccactatatatatatatatattcctagctcctgtggctttggttctctgtcacatctgtctgtgctgctggtcctcagaccaccggaacccatggagagaaggggacctctctgcccagctctacaaaaccttatgctgcatcagacatccaaagattgttccgacatgcttcctggtgacccctggtggaatgagacatcaccagtgaggaactgttagacttaaaacatggacaaagtctggagcagaggaagcagactttcctgagtctaaagcggctactagaaaggtgttcctactatagctggttttcatgggaaagccatctgatgcctgaatatcacccctatttttcataaagataagaaatctatttttattattattattattaaagcaacaccacctttcacaatgatcaggtagtagccatgttttaaaggaaattcaatgttacagacagctgcctctgaccagtcagagcctaagagtagatagatggtggtctaagcctacgcttgttacttaaacacaaaactgccaaaaccttctctctactatcttgaatgtttaccatcagcattattttatgattatttaatatatattccttgattgttaactgctaagaagttgacttcctaggataattttgtgaatctgtttacaagatgccaagcatccagtcctgttttctttagaatgtgtgcttacacgggtgtcctgagactttctctatttgaaactgagccttctttgtaatgtaaataagctctcagagtttgtgcgatgatttgtgagccttgccggacaagcggtttgttcatgcgcaaaccaaacgtaccttcacccagtgcaatatatttgtgtgactgcttgtgtctttttatgacttttttgccttttagaaaattgttaaataaagcaagtatatttttattttc

SEQ ID NO: 260 - DNA, 1018 bp, Rattus norvegicus
gtgtggagcaaagatacatctttagccatggatgtgttcatgaaaggactttcaaaggccaaggagggagttgtggctgctgctgagaaaaccaagcagggtgtggcagaggcagctgggaagacaaaagagggcgtcctctatgtaggttccaaaactaaggagggagtcgttcatggagtgacaacagtggctgagaagaccaaagagcaagtgacaaatgttggaggggcagtggtgactggtgtgacagcagtcgctcagaagacagtggagggagctgggaacattgctgctgccactggttttgtcaagaaggaccagatgggcaagggtgaagaagggtacccacaagagggaatcctggaagacatgcctgtggaccctagcagtgaggcttatgaaatgccttcagaggaaggctaccaagactatgagcctgaagcctaagaatgtcgttgcacctactgtcctaagatctgcccaggtgttcttccatggcgtacaagtgctcagttccaacgtgcccagtcatgaccttttctcaaagctgtacagtgtatttcaaagtcttccatcagcagtgatcggagtcctgtacctgcccctcagcatcccggtgctcccctctcactacagtgaatacatggtagcaggctcttgtgtgctgtggatattgttgtggcttcaaacctaaaatgttagaagaaacttaaaacacctaagtgactaccacttatttccaactcttcaccgtttttggttgctgttctcaagaagttgtgatttgctataagacttttagatgtccttaatgattctttctgtctaagaagaatgatgtgctgtgaaatttgttaatatatattttaaaatatgtgagcatgagactacgcacctataaatattaatttatgaattttacagttttgtgacgtgttttattaacttgtgtttgtatataaatggtggaaattaaaataaaataaaaacattatctcattgcaaaaaaaaaaaa

SEQ ID NO: 261 - DNA, 1865 bp, Rattus norvegicus
gttcagcgttcggctgctctccacggcaatccgctgccccgggtgggcaccccgaagcatgaacacgcctgcaactctgcccctggggggcgaggacaccacctggacccctgggatcaacgccagctgggctccggatgaggaggaggatgcagtgcggtccgacggcacggggacagcgggcatggtaactatccagtgcatctatgcgctcgtgtgtctggtgggcctggtaggaaacgccctggtcatattcgtgatcctacgctatgccaaaatgaagacagccaccaacatctacctgctcaacctggccgtcgctgatgagctcttcatgctcagtgtgccatttgtggcctcggcggctgccctgcgccactggccgttcggggcggtgctgtgccgcgcagtgcttagtgtggacggccttaacatgttcacgagtgtcttctgcctcacagtgctcagcgtggatcgctatgtggctgtagtgcaccctctgcgagctgccacctaccggcggcccagcgtggccaagctaatcaacctgggagtgtggctagcatccttgctggtcaccctgcccatcgcagtcttcgctgacactaggccagctcgtgggggtgaggcagtagcttgcaacctgcactggcctcacccggcctggtctgcagtctttgtgatctatacttttttgctgggcttcctactcccggttctggctatcggattatgttacctgcttatcgtgggcaagatgcgtgctgtggccctgcgggctggctggcaacaacggaggcgctcagagaagaagatcactaggctcgtgctaatggtggtgactgtctttgtgctatgctggatgccattctatgtagtgcagcttctgaatctgtttgtcaccagcctcgatgccactgtcaaccatgtgtccctcatcctcagctatgccaacagctgtgccaacccgattctctatggtttcctctcagacaacttccgacgctctttccagcgggttctgtgcctgcgctgctgtctcctggaaacaactggaggtgctgaggaagagcccctggactactatgctactgctctcaaaagcagaggtggcccaggatgcatatgccctccattgccctgccagcaggagcccatgcaagcagaacctgcctgcaagcgagtccctttcaccaagaccactactttctgaaaaccatttcaccctccctcagcccacctgcaagcaggtctgcaccacactctcaagccagcaacttcaagaaaactcctgttgtcactaagccaggccctttcagcagcctgtgttctgtccctaggagcctcaggactcctgctagcccctgcctctcctaggactgactggctccaaggacaactccgtgggggtaggacttctctgggttttgggctagagtaccatccatcctttcctggacctctagcaatttttcaagaggcaggaagcaggtggtggtcagaaagggatgcctacccttgtgtgacttgtgacagtgactgcttggaagagcgctgggagggtgaggtaggcagagctaggctctctgctgtgtggtagcatagggcatacggtgatacaggggagaagatatgatacctccaagtgttttccctctgtgtctgtctgagtctcttgttgctaaatgagatgtctacgcaacagctgaaagcatttgctttcccaaggcaaatgtttctccagttgtcaaaggaccagtagcagacttcctgcgaatgcaaatgtttaaagaaggatggtgtggggcgttttttgaaaaaaaaaataattctgatttctggtcaggaattaaaaggcagaaagg

SEQ ID NO: 262 - DNA, 808 bp, Rattus norvegicus
aactgaatgtctgcccgtcgccctgttgtaggtggtaacttcaagtgcaatggtgatttcgccttcatcaagactcacaccgaggtcttgaagacgatcccaaagaacaatgttgaagtttacgttgctccttctgcaatccacttgaaaactcttgccgacaaccttaagggtactcacatcgaggttgctgctcagaacgtttactatgagaagcctggcgcatggactggtgagttgaacgttgaaatgctgcttgattgcggcctgaagactgtcatcattggtcactctgagagacgtcgtatcatgggtgaaactaacgaacaatctgctaaaaaggctgctcgtgctatctcccttggcatgactgttgctttctgcattggtgagactcttgaggaaagaaacgctggcaaagttgacgaggttaacttcgctcagctcgaggctcttcgtgccgttctgaaagaagctgactggaagaacgtcatcattgcttatgaacctgtttggtctatcggtactggtgtcgttgcctcacctgaacaagctcaggaggttcacgcttccatcagaaagtggctcggtgagaaggtttccaaggctgttgctgatgccacccgtatccaatatggtggttccgtcaacgctgctaactgcgccgctcttggcaagtgcccagatatcgatggtttccttgttggtggtgcttccctcaagccagagttcgtccagatcgtcactactctcggtgatgtcaagaaatgagcttgtaacgttcaaaaaaaaaaaaaaaaaaaaaaaa

SEQ ID NO: 263 - DNA, 487 bp, Rattus norvegicus
tttttttttttttttttactccaaagggtttattgagacagttttttttcacatacaagttgggacaaaaaggaaggggcttataaacaggaacctgaaaggggaaccaagggcataaggtgggacccaaataaagagtgaaataaatagaggccaaagtgtggagcaaggagactgacagactatcacacagtgataacgtggggtaggcgccattaaaatcccattcctttacacacatatacactgagctaggggcacagcgccccctccaccctccacatctcgaggagggcctgtggctaggacaatgccctggaggagtggaggccctccccaggaaggcctggccccagaggcttgattagtgttggaaagcaagaagggactgaggtccaaaaggacaatctggggcccacatacgagggccctatgacaaaatgagatcccaaaggacacccagctggggctgtgtcaacctcaggat

SEQ ID NO: 264 - DNA, 2460 bp, Rattus norvegicus
agggtaattagacctctgcctggcggtagtagatcccgagatgaaaggggctctggcgtcactggcaggattttatgtccatgaatgcagggaacaaaccagaaacccccccaattctcccctgcgagtgaaagctattatatctgaaaatgacatctttctcaaaacgtttcaccgagcgtcgctcctggacagagccgcaggggggatgaggtatctccagacaggacaagtctctgaagacttcccagcccctaacccagtaccatttaccaagccagcttgcccctagctctcccacctgccactccccagcccctctaaccaccggccctcccgtttttttggggcacagggcatggtgtgaaaggctgagtactgagggggatactatgggtgctgtcccctagggcctgggtggcggggggtgggtggcctgtgggcgtggggggggggcagtgtgcccaccccagtctcttggcgtgctggagggcatcccggatggaattgaagtgaatggaacagaagccaagcaaggtggagtgtgggtcagacccagaggagaacagtgccaggtcaccagatggaaagcgaaaaaggaagaacggccaatgtcccctgaaaagcagcatgtcagggtatatccctagttacctggacaaagacgagcagtgtgtcgtgtgtggggacaaggccaccggttatcactaccgctgtatcacttgtgagtgctgcaagggcttctttcgccgtacaatccagaagaacctccatcccacctattcctgcaaatatgacagctgctgcgtcatcgacaagatcacccggaatcagtgccagttgtgccgcttcaagaagtgcatcgctgtgggcatggccatggacctggttctagacgattcaaagcgggtggccaaacgcaagctgattgagcagaaccgggagaggaggcgaaaggaggagatgatccgctcgctgcagcaacgaccagagcccactcctgaagagtgggatctgatccacgttgctacagaggcccatcgcagcaccaatgcccagggcagccattggaaacagaggcgaaaattcctgccggatgacattggccagtcacctattgtctccatgccggacggagacaaggtagacctagaggccttcagcgagtttaccaagatcatcaccccggccatcacccgcgtggtggactttgccaaaaaactgcccatgttctccgagctgccttgtgaagaccagatcatcctcctgaagggctgctgcatggagatcatgtccctgcgggcagctgtccgctatgaccctgagagcgacaccctgaccctgagtggggagatggcggttaagcgggagcagctcaagaatggtggcttgggtgtagtctccgacgccatctttgaactgggcaagtcactctctgcctttaacctggatgatacggaagtggctctgctgcaggctgtgctgttaatgtcaacagaccgctctggcctgctgtgtgtggacaagatcgagaagagtcaggaggcctacctgctggcgtttgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagtttggtgaagcgggaagtctccgagggccggttcttcagcaccagagcccgaagagcccgcagcagcgtctcctggagctgctccaccgaagcggaattctccattcccgagcggtctgtggggaagacgacagcagtgaggcaagctccctgagctcctcttcctctgacgaggacacggaggtctgcgaggacctggcaggcaaggcagcctctccctgaggccccttggagggcgatggggaaggagaaggagcatgctactccttctccagggcctctgccctagagctgggcacgcccacatgctgggagcaaggccacaggctggccgcctcccactcaagaccaccctcctacccctgagcacgccacacgtggccaagctcccttgttatttgttctgtagttccctctgcctgggatgcccttccccctctctatgcctggcaataccttgtccctttgaggccccactcaagtgtcacctccttccccagctctcccaggcagaaatagttgtctgtgcttacgtggttcatgcttcttctgtgacacttctcactgttttataattagtcgggcatgagtctgtttcccaagctagactgtgtctgaatcatgtctgtagcccagtgcccagtgccgggcctggcatagagtaggaactccataaaaggtatgttg

SEQ ID NO: 265 - DNA, 605 bp, Rattus rattus
aagtaaataaatttaattgcaaaagcaacctgtcttgtaataggatttacatggttcctgatgttttaaatgcatgtaattagcagcataaatacagtaattgcacggtccaaatcagagtatcatatagatttaatatatcaaatcgtccaacaacaaggtaataactgccttggaactttacaagaacacctcattttatccaacgcaaggttcaaacatactaagaacaaagtctgctcctatgccaagcgccaaggctggacaatgaattaatcctttgaaaaggaataggagtcattgcattttcttgtgtttgagaggcccaagaccttatagaatagccaaagagagcagtggtgaaattcagcaagttttgaaagaaatcaaaaagttcaccatgaacgccacaatacacaggtcacaccagccaacaccacggtatggatctgaatgtgaatactgcatttcctaaaacgtcacactgccactaactgcaccaggtacatggaagacgtctgtggaaatttctctctagcgtgggggctccaaacagaacctacaacacacagcagtatactaactgcagaaatgccaactagaag

SEQ ID NO: 266 - DNA, 447 bp, Rattus norvegicus
gcagtgtgccagtgccgccgaaagagctatgggcagctggacctctttccaacccgggacacctaccatcctatgagtgaatatcctacctaccacactcacggacgctatgtgccccctgccactaccaaacgtagcccctatgaagaggtttcgacaggcaatggcagtagcggtctctcttacaccaacccggctgtggcaaccacttcggccaacttgtaggagcaagtcaccctacccactcgggcagtggcagttggctccagcagtccactccctcagtggtcgctgccagacccctgcactctgatctgggctggtgagccaggactcctgataggctgatcacagccttcctcagaggctttgtcaccacgttagcctggtgaagcccagccctgccctgagggacactggggtagtggtggctctcagaaagactga

SEQ ID NO: 267 - DNA, 1412 bp, Rattus norvegicus
ggtgcctcttctgcaccactctccagggcactgcacctcttaagagagcctggctgccctttatcagacactgccttctgccaccgggaagcccgctggagggagccagaggaagaaatggccatggaagatattcccactatggttaaagtagaccgaggtgaaagccagattttatcctgccgggggagaaggtgtggcctcaaagtacttggctatgtcacgggagatatgaaggaattcgccaactggcttaaagacaagcctgtggtgctccagttcatggactggatacttcgtggcatatcccaggtggtgtttgtcagcaaccccatcagtggaatcctgattctggcgggacttctggtccagaacccctggtgggcgctctgtggctgtgtaggaaccgtggtctccactctgaccgccctcttgcttagccaagacagatcagcgataacggccgggctccagggttacaatgccaccctggtgggaatactcatggctgtcttctcagacaagggcgactacttctggtggttgatattccctgtatctgctatgtctatgacttgcccggttttctcgagcgcgttgagctccctgttcagcaagtgggacctgcccgtcttcactcttcctttcaacatggctttgtcgctgtaccttccagccacaggacactacaatacgtttttcccaagtaaactcttcatgcctgtcagctccgtgcccaacatcacgtggtccgagctcagcgccctggagctgttgaagtctcttccggtgggagtcggtcagatatatggctgtgataacccgtggacaggggccattttcctgtgtgccatcctgctttcctccccactcatgtgcctgcacgctgctatcggatcgttgctgggagtcatcgcaggtctcagtcttgcagctccgtttaaagatatcttctctgggctctggggtttcaacagttccctggcttgcattgcgatcggagggatgttcatggcactcacctggcagacccatctcctggcccttgcctgtgccctgttcactgcctactttggagcctgtatgacacacctgatggctgcggttcacctgccagcttgtacctggtccttctgcttggccacactactctttctcctgctgaccacggaaaatcccaatatctacaggatgcccctcagcaaagttacctactccgaggagaaccgcatcttctacctacaaaacaagaaaagggtggtcgactctgtgtgtgtacatgtctgtgtgtgtggctgtatgtgtatcttgcctgtgtgtgtgcttctgcatgtgtatctatgtgtctctgtgtcttcgtgagtttgtgtgtatatgtgtctctgtatttctgtgggtgtgtgtgtgtgccg

SEQ ID NO: 268 - DNA, 632 bp, Rattus rattus
gagggcgatgccattttgctttattgaacacaacaccaccggatatttgtagtcatgaaacaatcgtaagatcaccgcccatgtgccctctaaagtgttaccctcatgcactagatccaggaatccactttacacagccatgataagtaattcgcagctcgtcagccagtatccgccatagttcatctcacaaaaccacgtgtgagaagaaagaagtacaaggaaatataaaaagagttcagaaaaatatttccatatctggtcatgatcttcctggttttctcagtcgtcagtagttgatcatcttgcgaagggcatcatagcacttccatttgtctgggatataaaagggctcaaaaatgtgaggaaacggggtgtcatatccacacactctagatattggagcctctaggttcaagaaacattcttcctggaccgtggagctgatctcagaggcaaagccgcctgtcaagggcgcctcgtggctgatcaacagtcgccccgttttgatcacagacttacaaactgtatccacatcccaaggcacaatggtccgcagatcgatgacttcacaagacactccaagcttttcttgggccatggaagccacctcccggatgacatgaacctga

SEQ ID NO: 269 - DNA, 353 bp, Rattus norvegicus
tagagcgcgatgaggaaaagggctgagctgagctttggttctccagaatgtaagaagaaaaatttaaaacaaaaatctgaactctcaaaagtctatttttttaactgaaaatgtagatttatccatgttcgggagttggaatgctgtggttacctactgagtaggcggtgactttgtatgctatgaacatgaagttcattattttgtggttttattttacttcgtacttgtgtttgcttaaacaaagtgacttgtttggcttataaacacattgaatgcgctttactgcccatgggatatgtggtgtgtatccttcagaaaaattaaaaggaaaataaagaaactaactggtt

SEQ ID NO: 270 - DNA, 2047 bp, Rattus norvegicus
aagcttgattcaagttcagaggcttatgatttctgagactgcttcctagagctgtttccaggtgccaaatgtaggctttctcctcctcctccctcctgtgtgtgtgtgtgtgtgtgtgtgtgtgtgtgtgtgtgtgtgtgtgtgtgtctgtctgtctgtctgtctgtctatctgtctgtctccctggtgcctttcttttgtcacaatataaagatcagcagattggacaaagtgatgctcctttatagctcagtcttatcctttttcctacaaggctttaagggatgccaggagagaagatagttcagtcctcctgattgcatattaattctcagattggttcctagacggatagctttaagtctcccttgccatacaataccgttaagcatgatggcaagtccagtaatctgagtacattgacaggtacccaactgtgtgtgctgatgtattgctggccaaggactgaaggatctcagtaattaatcatgcacctatgtggcggaaatatgggatatgcatgtcgacactgagtgaaggcaagattatttggtctgtgtggcgtggagaatttcatgtgcctgtgtgggtgcaggctttctttttcttcaaaaaaaaaaaaataaaccactttagatcgtgtcgcctcccctcacttctttgattgattttgcgaggctaatggtgcgtaaaagcactggtgagatctgggggcgcctccttggctgacgtcagagagagagtttaaaaaggggagaccgtggagagctcgatagcggctgaaggagacgctactggagtcgtctctgccgcctgcggacctgcgtctagactgacccaccgcgctcaagctcggctgtctgaggcaggggagatgctgtcctgccgtctccagtgcgcgctggccgcgctctgcatcgtcctggctttgggcggtgtcaccggggcgccctcggaccccagactccgtcagtttctgcagaagtctctggcggctgccaccgggaaacaggtaaggaaatggctgggactcgtcccctttgcgaattccctagccttccccttagtcttgctgtagcccctgcgacaggtgttttagcgggcgcttctcagagtcgctcagcccctgagctcccagggaaacttttgaagtctagggtccgctcttactcgttccagaattgatcggcgctggtggtcaccttgcaggtaagttcccccttcgctttcaggaaaattccgaaagcctgcaagagagcggggagagactgagctctatccctggtactggcacgagggttgctgacccaggtgctgaaaaaaaatccggcaagaactcaggtccatggtccatttcgtgtctcataaaggaaaatggagctgctcgaactattggcatactatatttacaaaacgacttcctatcatccatggtttctctgtgttttaaggcatagcactttctgaaagacttgggtttgaggaagcttttttccctgtgcataatctagtgaatatagcagccatccatattactgtggaaacttggttttgaatgattaaatcttattttcaaaccgcatttctccctttctcccattcccccttttgctctcctccctgccctatccaggaactggccaagtacttcttggcagaactgctgtccgagcccaaccagacagagaacgatgccctggagcctgaggatttgccccaggcagctgagcaggacgagatgaggctggagctgcagaggtctgccaactcgaacccagccatggcaccccgggaacgcaaagctggctgcaagaacttcttctggaagacattcacatcctgttagctttaatattgttgtctcagccagacctctgatccctctcctacaaatcccatatctcttccttaactcccagcccccccccccaatgctcaactagaccctgcgttagaaaccgaagactgtaaatacaaaataaaattatggtgaaattatgaatagcgagtgtttgacttcttattgagtaaattgttttgttcagga

SEQ ID NO: 271 - DNA, 536 bp, Rattus norvegicus
tttttttttttttttttggaatgatcaaagatgtctttataaagtttttcacgacttcattctaaatatacagaataaaaaatggcgtactcatttgtgagacaccaaccagattttccttatactgtctcaaaatttaaagatcaatttccccagagggtgtgcaatgcatcataaaatggcctttttgagggtgggaaaggaaggcatattacattgttccatgataggcatgcaagactgctatccaacatatataacttatatacatttggtgacttagaaaaaccaatcatttgtgacaagcctgaaaagcctggcatatttaacatacgtcagaaggttctgtgtggccgaggttctccagttggaccatgtggccctgtgaaagtgtcagaaggccaattttgttaagtttgcagcagaacatcatatccaccctaaagaatacaatgtggattgaatcgaaggtggagaccttaccttaacaaagaaagcaaaagtatgtcagtgtaaaatgtggactaaactgcttt

SEQ ID NO: 272 - DNA, 700 bp, Rattus rattus
catgaaaatatatttaatcttattcaattagaaatcctgtctcgctccccggttactttcaaaccctgtcaacaaatgttgaaaatggtaaaagacaactcacggtgattggaaggtaggtaatcaaacacttgggacggccgacctagccacaaggtcttcgctcacttggaaggaagggatcacacgattactatgaatttgaagtgtgacagagtctgaagctatgtcgttaacactggtgtgatacacggaggaatgggctctccagggaagggtgtcactgagcacagacagacagagtaacagaaagggtaggagacacttctgagatactggctagttctgctgaagattagtcagagtgaaaaaaatcaatgaccggtgatgagtgactttaaagagaaggtagctctctttgggactatggaccttcccatgattctagattccggattacagaaaaggataaaaagattaacaaatcaccgaactagagactcctgccgctgagcctccaggaatggcagggcccacttgctcatcttgctagcaccctcacgagaagtagaggtggctgctcgccaggcctccaccagcggaggcctggtacctcattgggtctagcaccaagcgcgggtctcctgagaggccagcacctactgggccatctttcggatcatgtaattcaggatgcctc

SEQ ID NO: 273 - DNA, 484 bp, Rattus rattus
atagaaagagatatttaatacttttaaaaaaaaaaaaaattaggagtaaagtccacttcacaggctggaggacagtgttgcccatctagggggcatgggtgtggccccacgtaccagggacaagccacgggttgtggggcagctgtagagaagagtgtaactgagtccagccaaagcctccctcatgatgcagagccgcggctgtggccagcctcgcatgctggttgaaaagggacctgccaactgcctgtggccagctgtagagtcacatgagcaggtagcagtggagctggctcaggggaaggtgccagggacctgggaatgtccactcttcagggcctttgtgcttggtcttcaacagggctgagctgggtctgtggtcccatgggaagtgtacacgttcatgccttgtgcacttctgcatgagcagcaggtgccaggtgtctccatatgctgagctggctgtgcttgcagcctcgtgccg

SEQ ID NO: 274 - DNA, 357 bp, Rattus norvegicus
atggacgtgtttctcatgatccggcgccacaagaccaccatctttacggacgccaaggagtcgagcacggtgttcgaactgaagcgcatcgtcgagggcatcctcaagcggccgccagaggagcagcggctgtacaaggacgaccagctccttgatgatggaaaaactctgggcgaatgtggcttcaccagtcagacagcaaggccacaggccccagccacagtgggcctggcctttcgagcagatgacacctttgaagcgctgcgtattgaacccttctccagccctccggagcttccagatgtgatgaagccacaggattctggaggcagtgccaatgaacaagctgtgcagtga

SEQ ID NO: 275 - DNA, 449 bp, Rattus norvegicus
ttttttttttttttcttgaaaaaacggggtttattgatttttaaactgcaaatagtcgttacaaaaagtttttttttcttttaaataaattcacacaaagaaagagaaatagaaagcgacggtagtgaccagcaagaggaataataattacattcatctttatgtgtgtgccagttgtttacatcaacatcggaaaactccaacctggagtccagaacctcaaatctgcaagcggaatgtcttgagatgggcacatggaattcaaagggtttttctctctctctcttttttttttttttgttttcccttttagaagctatacataaatggtggttttccttctgtactgtcacagaacttatacattctcagtcctacctgtgaaaggcctaaggagaaaaaaaaacctttgcggccgctccaacatcagaacctcgtgccgaattctt

SEQ ID NO: 276 - DNA, 1292 bp, Rattus rattus
aagggcttgcacacttttaatctgacttctctaaccaagtctgagaacattttgtcagccacactgtatttctacattggagaattggtgaacaccagtgtgaactgtccagaatcccaaggttgttcccatgacagccagagacaacacatccagatagacctctctgcatggaccctccaatccaaccaaagccagctcttgggtcatctgtcagtagatacggccaaaccttatagagacagcatgtcttggctgtcaaaagacatcactcagctcttacggaaggccaagcaagacgaggagtttctcataggatttaacattacctccagagcacacgagcttcccaagaggatgctgcttttcccagagccttatatcttggtgtatgccaacgatgccgccatttgtgagcctgaaagcgtggtatctagcctacagagacaccgcgatttcacagcaggaactgtgcccagactggatagccacgtcagagaagccctctctgttgagaggaggaagaagcgctctactgggatcttgttgccattgcagaacaacgagctccctggggccgagtatcagtacaaggaggctggagtgtgggaggagagaaagccttacaagagccttcagactcagcctcctgaaaagagccggagcaaaaagaaacagaggaaagggcctcatcaaaagggacagacactgcagtttgatgagcagacactgaagaaggcgaggcgaaagcagtggatcgagcctcggaactgtgcccgcaggtaccttaaagtggactttgccgatattggctggagcgaatggattatctcccccaagtcatttgatgcctactattgctccggagcctgccagttccccatgccaaagtctttgaagccatcaaatcacgccaccatccagagcatagtgagagccgtgggggtcgtctctgggattcctgagccctgctgtgttccggagaagatgtcctcgctcagcatcttgttctttgacgagaacaagaatgtggtcctcaaagtctatcctaacatgacagtagactcttgtgcttgtagataacctagcagagaacacactcaaacgctccattcaatcattaattgggttttatggacttttatttttgtcttttgcactgccaatgcattttgtcccaaaagatgttttatagcagaaagaaaatgaacaaagagatcgaagatttccaccaaacaaagccggactgtcttttttttcccttcgaatgtaactaaaagtaagattttggt

SEQ ID NO: 277 - DNA, 560 bp, Rattus rattus
actttattcaaataattaatttcttttctctgtgaaactgagtaggactaaagagaggagagcccatatattaaactcttaaatagatcctttgagttcagcgtccagtcaaggagaggcacgggtcacaggtcttatcccaggagatgaggtcaccaaggagcctgtccattggggaagatagcaaagtgaatgtcttttaaagaaagttctcagaggagaaaaaaaaaatagaagatccccaagtctctgaaaccgaagtagtctctccctcctcggtgttgcccagaacagaggttctgagctagcttctgccgagatgtatgactgctccatcctggcatgaccgagagccatgtgcttgggttagtccagcttccgtgtgcaggtcgaggactcaggcatctgagccctgtggagactggaaatcacgaacttcccaggtgtggggaggtactgttctggttcacctgaaaatatcctttaagattggctggcgttttatagtcttctttcaagacccggtgtgtgttgttgatgacaatgggggccgggttccc

SEQ ID NO: 278 - DNA, 499 bp, Rattus norvegicus
tttttttttttttttttgcaagggagggaagagtttatttggctttcaattccagttacagttcatcattttggggaagtcaaggtagacgtttgaagcaagtaccatcctgtctggtcaagcagagaaataaatgcactgaaggcgcttgctgctcactttctaacaacccagaggcacacttgttggaacggccaatcttctgactagaatagctagaatacctaccccaccacctcagcttagaagaggtcactgaatccaatttccattacaggattggtcttgatttgatcaatgggaaaccacaagacaacaagcaagcaggggtgtttgagcgaagagcctgaagttcaaaccagaagccacatccccattccttgaatggatcatattgggggccgtgcataacggtgcatgtctttaattcaagtactcaggaggcacagaaaggtggatctctgggaattgaagccaagctcatctacaaaacgatttt

SEQ ID NO: 279 - DNA, 1947 bp, Rattus norvegicus
ggcacgagaggactttgatcttcaggatgcctcagaagtggatttctgctctgctcctactgcagataagtttctgcttcagatctgggaactgtgggaaagtgttggtgtggccattggaatacagtcactggatgaatttaaagataatactggatgaacttgtacagaggggacatgaagtcactgttctcagaccttcatcttccgtctctcttgatcccaaaaaagcatctggtcttgtatatgaaacatctcctacaacttccaataatgatgaagtagaaaagtctttttacccagtgggtgatatgtggacatacgatgtgccaaaatatacatgtttgagatactacccatctttgaacaaaatgttcgggcaattttctgatttgtggttacagctttgtagagaagttgtttcaaacaaggaacttatagcaaaactaaaggaatcccagtttgatgtggttctttcagatgctgttggtccctgtggtgagctgatagctgagatactgcagttaccatttgtgtacagtcttcgctttgccaccgcccctggaatagaaaagtacagtgcaggacaacccttccctccctcttatgtacctattattttgtcaggatttagtggtcaaatgacattcatggagagagtggaaaatatgctatgtttactttattttgattcctggttcgagtcatttcctgctaaggattgggatccatttttcagcgaaattttaggaagacccactacaatggttgacacaatgaagaaagcagaaatatggctcattcggtcctactgggacttggagtttccccgcccatccttgccaaacattgagtttgttggaggacttcactgccaacctgccaaaccattacctaaggaaatggaagactttgcacagagctcaggagaacatggtgtgtgggtgttttctctggggtcgatgatcaggaacataacacaagaaagggctaacacaattgcatcagccctggcacaaattccacaaaaggttttttggagatttgagggcaagaaaccagacaccttaggacccaatactcgggtgttcaagtggataccccagaatgaccttcttggtcatccaaaaactaaggcttttgtaactcatggtggagccaatggcatctatgagtcaatccattatgggatcccccccatggttggcatccctttatttgcagaacaacgtgataacgttgctcacatggtagccaaaggagcagctgtttctatagattttcatacaatgtccagttcagatttgctcaacgcactgaaggcagtcatcaataacccctcctataaaaagaaagtgatgtggttgtcagccattcaccatgaccagcctctgaagcctctggacagagcagtcttctggattgagtttgtcatgcgtcacaaaggggccaagcatctgagaccacttgcacataaccttgccctggtatcagtacactctctggatgtgattggattcctgcttgcctgtgtgctggccattgttttacttgctgtaaaatgctgtctgtttctttaccgattttttgtaaaggtggcaaagaataaaagggactagggttctttaagaaggaaggctgtgatctgtggtcgtgatgggcatgactactccctttattgctggaactatatatcagatgctccttgttttagaagacattgagctaattgatttatctatagatgtcacactataggttaagaaagtaaccgttttaaatctttattttctcaaatccaccgttttcatattgattctcgatgtgatagtgctgaggataatgataatccctgaaacaccaacttgcttatgggcaaagatataggaagcctaaactttttactgtgaattttcagatatttataaaataaaattgaataaaatt

SEQ ID NO: 280 - DNA, 2619 bp, Rattus norvegicus
  misc_feature (1356)..(1356): n is a, c, g, or t
ggcaccaggctcgcctcacgccggcggcgcggactgggaagcggcgccctcggctgcgctcggttcggaacccgctctgtggagtcagaggcagcgacgggcgccaggccgcccgggccggcggaggcggccgctgaggggagtgtgaggaggcagcggcggccctgggaatgtgaggcggcgcggagcgggagagaagagccggggtgggggcacgagccgcggctgccgtgcctcagacgagccgcgagcctctcgcttcagcgcgcgaccgccgggagcttgggggctgggtgcgggggaccgcgcggggctgggttctctgattcattcattctccgcggcccggagcccgaggccgcgggtgctgcgaggagaggcgggaagagggggcggccgcgagcggggctcctttgtgctcggcgggggccgggaagccgtgggaggtgggctcgggccccctgcgctgctccccggcggccgctgcgcccccagctagccgccagcctggaaatggctccgctgatgctcctcgtgagaacgaatcgatccttcccagccttctctgcctgctctccacctcctctctgctccgagtcttaggagaacgaacattcaaaggacagattccaatgtggtgtgctgtgcacatcgcgagcggctggggtttgcacttcgagatttcttctttataattttttttttttaatgtaagggagacagtggaattgctacccgtagaatttttattcaagtgcacgtcgcgttgggttgcacgctccacccccagggacctggtgtggtgaaatttgaacccaccgccttagcccaaaggccgagtaacctggctgcttgagtgtcgtggaagacgtgagcgaaatgatcagcgaactcattttttatcagactcactgaagctggcttttgcgtttttctacacgtacactaattttatggaatagttaaagtgctatattctccgcgcaaccttttcaaattccaaatgtttgaacgttttggtgtcagcgcgagtgaaatcattttaccgacaagaactaactgaattgtctgcctcgttgagttgcctccggaaaagatctcgggggtggaaaagcaactgcaaaataacagacggagaaaattccttggaagttatttctgtagcataagagcagaaacttcagagcaagttttcattgggcaaaatgggggaacaacctatcttcagcactcgagctcatgtcttccagatcgacccaaacacaaagaagaactgggtacccaccagcaagcatgcagttactgtgtcttatttctatgacagcacaaggaatgtgtataggataatcagtctanacggctcaaaggcaataataaatagcaccatcactccaaacatgacatttactaaaacatctcaaaagtttggccaatgggctgatagccgggcaaacactgtttatggactgggattctcctctgagcatcatctctcaaaatttgcagaaaagtttcaggaatttaaagaagctgctcggctggcaaaggagaagtcgcaggagaagatggaactgaccagtaccccttcacaggaatcagcaggaggagatcttcagtctcctttaacaccagaaagtatcaatgggacagatgatgagagaacacccgatgtgacacagaactcagagccaagggctgagccagctcagaatgcattgccattttcacataggcagccaattttctttgctggagaacttctctggccttggttatttttgaaattagtgaagtcaccatttcccttggaggaagaggatctgcagtttattctgattgaaaagatacaaatgacccctgactgagagaaacccctggaagaaaggagacagcctaaaaagacaactaatgtcgtgcacttttaacattgaagaatgaaaagaagggagttctttttaaagaagacacctgcttgaattctgggtgaggaggacggctaaactagagccatctagagaaagaaaagatggatttgggaagttttcatgctttagaacttaggagagtatcatggtccttgcttcactgatatccagaagactgagaagcccttgatgaagggaggaaaatctgctggaaatcaaagtaactttgcgatgaagaaaagtaaaaaatccaagtggctggctttcttggacttctaactagactggttcatggattttatttcttttgaaacttaacaaactaggatctcttggctatgtaatcttggcacatgtaactgcccaagttcatgtattgtctgtcatgaatcctccgccctacctcacagggatgttgtgaggcccatgttaatgtctgtaagtagtaattcatgcttagctctttgttgatagtctctgtgtctttttaaaattataagtgctttattacaccttcaaacaaacattaggtaatattttttaaatggaagataatggcattgtatgtggttcatcactgagcatccttgtatgaagaataatttggctgcatgagatgttaagttgattcttttacgattgggcctttatatgatagtaataataataaaagctatgctaagaaaaaaaaaaa

SEQ ID NO: 281 - DNA, 2436 bp, Rattus norvegicus
agctttccggggcagcgagtggcggggccgggtgctgagcgagcggggcgtggagagcgtcgcgcggcccctcgcgccgggctccgtttgcaggccacagcccccgcgaggtggcccgccggccctgggccgcccgtcctctggcagctgtggtgagcgcagcgtcgggccggcatgaaggtcacgtcgctcgacgggcgccggctgcgcaagatgctccgcaaggaggcggaggcgcgctgcgtggtgctcgattgccggccctacctggccttcgccgcgtcgagcgtgcgcggctcgctcaacgtcaacctcaactccgtggtgctgcggcgggcccggggcggcgcggtgtctgcgcgctacgtgctggccgacgaggcagcccgcgctcggctgctgcaggagggcggcggcggcgtggcggcggtggtcgtgctggaccagggcagccgccactggcagaagctgcgggaggagagtgccgcgcgcgtcgtcctcacctcgctgctggcctgtctgtccgccggaccgcgggtctacttccttaaaggtgggtacgagaccttctactcacagtatcctgagtgctgtgtggatgcgaagcccatttcacaagagaagctcgaaggtgaaagaggcctcctcagccagtgcggaaagcccattctcagcgtcgcctacagaccagcttatgaccagggtggcccagttgaaatccttcccttcctctaccttggaagtgcctaccatgcatccaagtgcgagttcctcgccaacctgcacatcacagccctgctgaatgtttcccgccggacctctgaggcctgcacaacccacctacactacaagtggatccctgtggaggacagccacaccgccgacattagctcccactttcaagaagcaatagattttattgactgtgtcagggaagagggaggcaaggtcctggttcactgtgaagccggggtctcccggtcgcccaccatctgcatggcttacctcatgaagaccaagcagttccgcctgaaggaggccttcgagtatatcaagcagaggaggagcgtggtctctcccaactttggcttcatgggacagctcctgcagtatgagtctgagatcctgccctccacacccaccccccaacctccctcctgccaaggggaggcagccagctccacctttataggccacttacagacactgagccctgatatgcagggtgcctactgcacattccctacctcagtgctggcaccggtgcccacccacgccaccgtcgcagagctccacaggagccccgtggccacagccacatcctgctgagaccggtcggctaccagcgcatccccaagagcaactgtgacctttggattttttaaacttgtggacatttcatacccgtgcaatactgaagacctctctctgtcccgctgccccggtgagatggtgaggggtcagcaggcttgcagatgcacttcaggctaacccggaggatggtttctcgcgattgtaggaaggccaagccatgcccccctagcacagcggcgtgctaactactgtacttccagaagccccgcccactcaggaccgcctcatccttgcacctcagaagtcccggcttctcatttcaagtgtaaggcaatacacagtcgcagcaaagtaggagcaagctgtgctggaccaggaggggaggagtccgcccgtctgggaggaagcacaagtttcactgttaatttgaatttcggccaactttgtctgtctctgtcctctgtcacttcagggaagagagctggtcaccgctcagtcagaaaagttaaccccgctggatttgtcaagacaaaaggacctgcccgtctgaacccagtgtttctgaggttctgtctaggatcccatggaagctgttggtgtaaggagaagctcctgactcattggagtttcttgctcaccgagggctccttggtgaccttggactttggcatggtttttacaaatacttgaacctgtcccattgtatctctccctaaagcacctctggtgtcattcagaaagttgtcagaccctagaccaaaaaccacccctttgagggggtagcaggaactgcctgcgttctgggtcagtggtggtgactgacatactttttcagtttagtgtcctgtgtgctttttttgtcatccattgtgacaatgtttccctccctaccctggggagtcgttttcaaactactgattctggggtctgcatcgtttgcaatgtggtactactatgtccttcgtagattgtttttccaaggggggaaaggcaataagtcacccccaaacccatgtgaatgtgaagaaaagcagtgttgatgttttttttatatatatatatatacatgtagtacaaaattaaaaaaatgtcaaaaaataaaaataaaaagtgctaagtgaa

SEQ ID NO: 282 - DNA, 539 bp, Rattus norvegicus
cctcggcctccgggctgcgggaacgcccggactgggaacgccacgtcgagaggcgttcgcggaaggcgcgggatccaggacgtgctggtcacccccaaaccccaggccacccattatcgccttggttcgcccatcagagttgtaagaaaatggcagacaagccggacatgggggaaatcgccagcttcgataaggccaagctgaagaaaaccgagacgcaggagaagaacaccctgccgaccaaagagaccattgaacaggaaaagaggagtgaaatctcctaaaagcctaggaagatttccccaccccaccccttcatctccaagaaccccctcgtgatgtggaggaagagccacctgcaagatggacgcgagccacaagctgcactgtgaacccggcactccgcgccgatgccaccggcccgtgggtctctgaaggggacccccccactaatcggactgccaaatttcaccggtttgcccagggatattatagaaaattatttgtatgattgatgaaaataaaacacacctcgtggc

SEQ ID NO: 283 - DNA, 541 bp, Rattus norvegicus
tttttttttttttttttacaggtggtttggtcctttatttctattattcatacaaaagaacatcgatcttaacagttctgggtcagttgctgcatcacagttgcgcagaggctcatcagctgcaggtgctcatctgcaccatctgctaaacacttatccacctcagcaagtttttctgtaatgatggacttctgtttatcagacagattttcatcttctatgattgaatcatgaagttggttgacaagctgagtggctgcatgcccttcatctattaggttcttcagcacggcttctagtttgtcaaaagagccgctgtgacatgcagtgactattccctcaatggttgcagctggtattaccccagcaatgtctgtgatcacatcttccgagatttcctttccacctgttagtcgagtagcactttgaagaaatgtaattgctttccgtaaatctccttctgatattctaacaagataagctatttcctcatcgccaattttgacattttccttctcagcaatatccaataatcgcttct

SEQ ID NO: 284 - DNA, 3784 bp, Rattus norvegicus
cacgagcttccatgcccttctctgcgtggccagcctgaagcccttgggagccttcaatgtggatgtggactggtcctgggtcacagcactccagccaggtgcgccttccgtgctcaactcccttctgcatcaagaccccagcaacaaccagacctgcctcctggtagccagacgcagctccaacaggaattcagcagtcctgtatcaatgtgctacatccatcattccagatgaaattggttgccagccagtagagcacatccttatgccaaagggcaggtaccagggagtgacattggtcaggaaccacaatggtgttttggtatgcattcaggtacagtcccggaagccccgcagccttaactcggagctcaccggtgcctgcagcctacttacccccaacttggacctccaggcgcaagcctacttctctgaccttgaaggagtcctggatctgggtgcatctgtgaactctggtgactactacggaagcaaaggaggcagcacaggggaggagacgaaatcagccaggagactccgacgacaggcagtggaggaggaagacgaggaggaagctggcaccgaaatcgctattgttctggatggctcaggaagcattgaaccctcagacttccagaaggccaaagatttcatctctacgatgatgaggaacttctatgaaaagtgttttgagtgcaactttgccctggtgcagtatgggggcgtgatccagactgagtttgatcttctagacagccgggacatcaacgcctcccttgccaaagttcagagcatcgttcaagtgaaggaagtcactaagaccgcctcagccatgcagcatgtcctagataatatcttcattccaagtcgtggctccagaaagaaagcattgaaggttatggtggtgcttactgatggtgacatatttagggaccctctcaaccttacgactgtcatcagttcctcaaagatgcagggtgttgtgcgctttgccattggggtaggcaatgcattcgagaataataacacttacagagaactgaagctgattgcctcagaccctaaagcggcccacactttcaaggtgaccaactactcggctctggatgggctgctgagcaagctacagcagaggatcatccacatggaaggcacagttggagacacccttcaatatcaactcgcacagactggcttcagtgctcagatcctggacaaggggcaggtgttgcttggcactgtgggggcctttaactggtctgggggcgcgctgctctacaacacacagaatggtcggggccgcttcctaaaccagacagccaaggaggacttcagggccgcacagtacagctacctcggttattcagttgcagcgctacacaaggcccatggtgtctcctacgtggcaggggctccaaggcacaagctccgtggggctgtgtttgagctccagaaggaggacggagaggaaaccttcatgcgacggatagaaggagagcagatggggtcctattttggctctgtgctgtgccctgtggatatcaacatggatggaatcacagattttctgctggtggcagctccattttaccacatccgtggagaagaaggcagagtctatgtgtaccgcgtgcacgagcaggatgctcccttctccttggtatacacactgagtgggtaccctgggctcaccagtagccgcttcggctttgccatggcagctgtgggggatatcaatcaagataaattcacagatgtggccattggggcccctctggagggctttggggcaggcgatggggcaagctatggcagcgtgtacatctacaatggacactcaggtggcctgcatgccagtccctcccagcagatcagagcctcctctgtggccttgggactctactactttggcatgtctgtgtctggtggtttagatttcagtggcgatgaccttgccgacatcacagttggctctcaggatgtggcagttgtgctccgctcacgacctgtggtggacctgactgtgtctatgacctttacccctgatgcgctgcccatggccttcaaggacaagatggatgtagaactgtgcttcaaagttgactcttcagctgtaccttctgaaccaggccttagagggatgtcactaaactttaccgtggatgtggatgtgaccaagcagaagcagaggctgcagtgtgcagaccggagttgttgtcaaagctgccttatgaagtggagcggaggatcctctctgtgtgaacacttcgggctcatctccacagaggaggagctttgtgaggatgactgcttctccaacatcaccatcaaggtcagttatgagttccagacatccgaggaaaggaggaaccaccccaaccccatcctggaccactacaaggaaccctctgccatcttccagctgccctatgagaaggactgcaagaacaaagtgttctgcatcgctgagatccagctgaccaccgccatctctcagcaagacctggtggtgggtatcacaaaggaggtgaccatgaacatcagcctgactaactctggggaagattcttacatgacaaacatggctctgaattatcccagaaacttacagtttaagaagatacaaaagccactctctccagatattcagtgtgatgaccccaagccagtcgcttctgtcctggtcatgaactgcaagattggtcaccccatactcaagagatcatctgtaaatgtctcagtgacttggcagctagaggagagtatctttccaaataggacagcagatatcactgtgaccatctccaattccaatgagaagtctttggccagagagacccacagccttcaattcaggcatgccttcattgcagttctttccagaccgtcagtgatgtacatgaacacgagccaaagctcttctgaccacaaagaattcttcttcaacgtgcacggggagaatcactttggagctgtattccagttgcaaatttgtgtccccatcacattacgagatttacagattataagagtgaagcatctgacaaagactcaggcccacactgagtgcacccagagtcaagagcccacgtgtggaagcgatcctgttcagaatgtggaagaatggcattcagtgatctgcgctatcacatctaataaagaaaatgtaaccgtggccgcagagatctccatgggccacactaagcagttactaagagatataagtgaactgcagatccttggtgaaatatctttcaacaaatctctctatgagggcctgaatgcagagaaccacaggacaaagatcacagtcatcttcctgaaggaggagaagccacactccctgcctctaatcattggcagcagtatcggaggcctcctggtcctggtcgtgattatagccattctgttcaagtgtggctttttcaaaagaaaatataaacagctgaacttggagagcgtaaggaaggcacagctgaagtctgacagtctgctcgaagattagcccctgcttcctcacctgaaggagggagcttgaggcagtctggaagaagcccggataccccctgtcggggctccttactctctttaggacaatctagcaacatcaaacaaactgtagagtgttgttcgtagccacacattatctccacagtgtctgtgaattgtgaaaaaagggaaacttgggacatgcggtaataaataaatttacctttacaaaaaaaaaaaaaaaaaaaggggatcctctagagtctcgcgaagcactagaatgttctcgaggcct

SEQ ID NO: 285 - DNA, 1124 bp, Rattus norvegicus
gaattctggccactttgtcttctccacagcctgtgctcattgccaaggggacaatgacggcctccagtgtcctcctgcacactggacagaagatgcctctgattggtctggggacatggaagagtgagcctggtcaggtgaaagcagctattaaatatgcccttagcgtaggctaccgccacattgactgtgcttctgtatatggcaatgaaactgagattggagaggccctgaaggagagtgtgggagcaggcaaggcagtacctcgagaggagctgtttgtgacctccaagctgtggaatactaagcaccaccctgaggatgtagaacctgctgtccggaagacgctggctgatctgcagctggagtatttggacctctatttgatgcattggccttatgccttcgagcggggagacaatccctttcccaagaatgccgatggaactgtcaaatatgactccactcactataaggagacctggaaggctctggaggcactggtggcaaaggggctggtgaaagccttgggcttgtccaacttcagcagtcggcagatagatgatgtcctcagtgtggcctcggtgcgcccagctgtcttgcaggtggaatgccatccatacctggctcaaaatgagctcattgcccactgtcaagcacgaggcttggaggtgacagcttacagccccttgggttcatcggatcgtgcttggcgccaccctgatgagccagtcctgcttgaggaaccagttgtcttggcactagctgaaaaacatggccgatctccagctcagatcttgctcagatggcaggttcagcggaaagtaatctgcatccccaaaagcatcactccttcccgcatccttcagaacattcaggtatttgatttcacctttagtccagaggagatgaagcaattagatgctctgaacaaaaattggcggtatattgtgcccatgattacggtggatgggaagagagtccccagagatgctggacaccctctgtatccctttaatgacccatactgaggcccgtagtttctcagcttccctttcagttctcctgctaagcattgcctgctactcccaagaaagaaggactcaataaagccattgaagtgt

SEQ ID NO: 286 - DNA, 1493 bp, Rattus norvegicus
ggaaacttttgtaaaatgtttctttacatggaaatttcactttaggcaatcattggtctatattattgatttgattttacttgtagaactaagagcccctcattgagtgactattcagatttcaaagtgactcgaattgtttacatagcttctacctgaaggatttagaatctgttttctgatagcaaaactaatatatatggtggccagagtataactatgttcatactttggcctgggagataatttatcatgagcttttactatttaaaatgttacacatttgcctactattttataaatgatgttgccttcagaatttgtgggaaggtagaaaactcaaaatatctcgcatcttttgtgcaatggaaagtcttgagttttgatgtcctaaatatgattgcagaaattgttctgttgctcttaaaaaatggacctacatatgacaaaaatccatgctatctgggtaattctcccaacctgtaaggctgaggactgtggtgtgcgttgttctttagtgtcttccaccagcagtgcctcctgttaaaatgtgacagtctcccaatgttaaagaaactggacatatgctttctctgttattcttgttagacataagaaagtaatatgtttcttttcctgttgtaacattttacaaaagagctgctagtcagatctttattcttaaattaatctcaaactggatgtaaaaatttaaaaatattttttaatttatttttttaatagtagtataagaactctggctgctacttagttgttattctgttttccggatagaagctatttaaaaaagtccagtttctgtcccagggtagcaaaatgtacttcctcattttgttgttttgtgatttataaattacactaccttttgaatatacaaacctcattcttcattggacaatgtgaaggctttgggttttttgaagttaaatttgaaggtgcagtttgctttggcattccctcagctctaagatgtattaaccactgtgcttgcagaggccaggactaagattgtactatgaaacttactgagtacttttcacaaattattatcaaaggagagatttttagatttttgtattctgcttagtttaaaaaaaaaaaaagagtagtttccacgaagggttagtgcatttgatgctgttgctgccaaacaaactcagccaattctctaacatagcaggtgtgggaaggatgacacgtggctttgattttgagtgcattttccagaatactgggaaggagcttctgaagccttggatgtattgggtctgtcaaggtgcacgtgtgcctttgtaaatgttcgttctccatctcattcgtcaggtgatgggtggtgaaatgtagctgagctgaagactagaactcaataatcacttttgtgaacaagttggaattgtcatgttactgtgtaattggtttgcttttaagatgaacaataaattaaataaaataaaaaaaaaaaaaaaaaaaaa

SEQ ID NO: 287 - DNA, 613 bp, Rattus norvegicus
gcagcagccaagatgtgtgacttcaccgaggaccagaccgcagaattcaaggaggctttccagctgtttgaccgaacaggcgatggcaagatcctgtacagccagtgtggggatgtgatgcgggccctgggccagaaccctaccaacgccgaggtgctcaaggtcctggggaaccccaagagcgatgagatgaatgtgaaggtgctggactttgagcacttcctgcccatgctgcagactgtggccaagaacaaggaccaaggaacctacgaggattatgttgaaggccttcgtgtgtttgacaaagaagggaatggcactgtcatgggtgctgaaatccgtcatgtcctagtcacactgggggagaagatgacagaggaagaagtcgagatgctagtggcggggcatgaggacagcaacggttgcattaactatgaagagcttctccggatggtgctgaatggctgaggacatttacgtgtctcgagcctgctccttgcccagtgtgagattcctgtgtggccccagaggctccctaatcacagcaccttgcctgtctggtttcttttggatgatgtttgccttcaccaaataaaacttgctctctgtgctc

SEQ ID NO: 288 - DNA, 2104 bp, Rattus norvegicus
tggtatacagcggagatggcgactgcagtccggctgctggggcggcgagtttccagttggagactgcggcctttaccgtcgccccttgctgtcccgcagcgggcccactcgatgttgcctgtggatgatgatatcaacgggctaaacgaggagcagaagcagcttcgtcatacgatatctaagttcgttcaagagaacctggcccccaaggcccaagagattgatcaaagcaatgacttcaagaacctgagagagttctggaagcagctgggaagcctgggagtcctgggcatcacagcccccgttcagtatggtggctctggcctgggctacctagaacatgtgttggtgatggaagagatatcccgggcttcagcagctgtggggctcagctatggcgctcactccaacctctgcatcaaccagattgtccgcaatgggaatgaggcacagaaagagaaatatcttcccaagctcatcagtggtgagttcatcggagccctggccatgagtgagcccaacgctggctctgacgttgtctccatgaggctgaaagcagagaagaaaggagatcactacgttctgaatggcaacaagttctggatcaccaatggccctgacgctgatgtcctagttgtctatgccaagacagacttgactgctgtgcctgcgtctcggggcatcacagccttcattgtggaaaaggatatgcctggtttcagcacctcgaagaagctggacaagctaggcatgaggggctccaacacctgtgagctagtctttgaagactgcaaggttcctgctgctaacatcctgagccaagagagtaagggtgtctacgtactgatgagcgggctggacctagaacgcctggtgctggcaggtggaccccttgggatcatgcaggctgtcctggaccacaccattccctatttgcatgtgagggaagcctttggccagaagatcggccaattccagctgatgcagggaaagatggctgacatgtacacccgcctcatggcatgtcgacagtatgtctacaatgtcgccagggcctgtgacgagggccacatcactgccaaggactgtgctggtgtgattctgtatacagccgagtgtgccacacaagtagccctggatggcattcaatgtttaggtggaaatggctacatcaatgacttccccatgggccgctttcttcgagatgccaaactgtacgagatcggaggtgggaccagtgaggtgaggcggctagtcattggcagagctttcaacgcagacttccgctagcctggggccatcaccctgctcccagcagcaggaggcctttggaagcagagacgtggcagccctctgacttggctaaggaagctctgctgctcaactgccctcttgccagccctctgctcttcgtgaagtcggattctccagccgtgccagccagtcaatcaagaaagcctaaaattcggtccccagctccgaaaaaaaaaaaaaaaaaaaagaaccaaaagaaagcctaaaatggctgctaaaaggactttggcttttctggggtttgcagggagggtaacagtgtctgcgcccttgttctctacttctgaatgtagtaacctcaccctctggggtagcatatgacaggtacccaactccttttcgtgggcaagcctctggcaggggagctctttctgttgcaatgtaacagaggcattgcctctttcaattgtcagatacttgtggtctcttttcttgaggaaaaggcaaaaaccatgtccttcttagctgtttccccaagagctagctagacagttccagaatgcctgtgtggcagacccatgaagggcagagtccacagtctagccaagacaacttggagattggctccctggtgtggctgagtgtctacatcactccgtcacaggctagcactgggcctgctcacgtgaccttctgcagctgcctgactccggtggcccagcttaggttgcctggctcaactccagccttgctgtctatgtatatttctctagacgccctgtggctaattttgttacaaccacacaggctctgctgccattttgtattaaacatactgcaaagtaaaaaa

SEQ ID NO: 289 - DNA, 666 bp, Rattus norvegicus
ctcacgaccgacatcgacctcctttctcattgcaccatggcggacgcctttgtcggtacctggaagctagtggacagcaagaattttgatgactacatgaagtcactcggtgtgggctttgccaccagacaggtggctagcatgaccaagccgaccacaatcattgagaagaatggggataccatcaccataaagacacacagtaccttcaagaacacagagatcagctttcagctgggagtagagtttgacgaggtcacagcagatgacaggaaggtcaagtcggtcgtgacactggacggaggcaaactggtccatgtgcagaagtgggacgggcaggagactacgcttacacgggaactaagtgatgggaaactcatcctgactctcacccatggcaatgtggtgagcactcggacttacgagaaggaggcgtgacctggctgccccgtcactgactgctcctctgccaatggctacccctaactcagcaccacgttgcctcatgtttctcccctctgacgttttatataaatactctttggttgggcttttcctggagatatgggacaccagcctggacccaggtcccattgtgtatgtggtttattttttaaatgtatccaaagggtgctccaaggtcaataaagcagagccaaggccacc

SEQ ID NO: 290 - DNA, 446 bp, Rattus rattus
aaatagattcaataaaaagtcaaacacacacacaaacacatcttaaaatagactttagacacgaagtgcgtgtttcttctccacagtactgtgcagagggggagggcagggggcggaggttcctccctagtatccccacaggctgagtaccaggcggcggggccagctccgccgcgacaacccccttctcccctccctgttaaatacacaaatatattatattcaatatgaattcagtctctttccagaaaaaaaaaacatacaaaatacgctggaagggggccatgtaaacctcgaggtggaaggactgggcgcaggcgggcaggccagagtccagtgtgtgagctgcgccccagacctctgggcgagtgcccatcgcctgcccccctcaccccagtggggggcgggcgcccagccttcaaggctgggggtgtccgtatggagca

SEQ ID NO: 291 - DNA, 574 bp, Rattus norvegicus
tttttttttttttttttagtagaatctttttttattcagaaaaaaaaaaaaagaacaaaacaaaaaaaaagtaaaacaaaaatgaaacccaaaaacaattttttcccaaacacacacaggagggggtatgggtaaggggaggtatctgtccatccagccccagcccccagcccatgtggttttggcagcaataagggaaatggggtaatggcccaaaaaataatggtgtgtgtgtgtatggaaagaagggggtgcaaaagccaaagggagcggtgggggaagggacagatgaggtcagtactgggaacgccgcaggtgagaggccatttcataacatttcttgttgatcaaaccaccgtggacaccttctttgcccatcagcaggactagcgtcttggcagtcatggtgacagtgacattgaacgtgggggctcccccggtgctcttggtacgaagatccattgtaaattccccgtcttgcagcagtgagtcacggatcacagaacatttctggcccccaagtgtcagcccattcacgaaaaaacttgaccggtctttgcctaccaggacacca

SEQ ID NO: 292 - DNA, 1204 bp, Rattus norvegicus
ccgcgatggcaagcctgggccgcctgctgtgcgcatgggttttgctgctgtgcgggcttgcaagccccgggctgtccggatcctatgagcgcggctccaagcgtcccatcatcggaataataatgcaagaatgttatgggaacatgacgaagttgggaagattctacattgctgcgtcctatgtgaagtttatagagtctgcgggtgcaagagtcgtgcccataaggctcgaccttaatgatgcacagtatgaaacactttttagatctattaatggagtcctcttgcctggagggggtgctaacctaacacattcaggttattcccgtgtggccaaaatatttttcaccaaggctctagagagttttgataatggagactattttcctgtgtggggaacatgcctgggattggaggagctttccgtcctggttagtaatgacaacttactgacactcacaaacaccagctcagtgaaattgcctttgaacttcacgagagattcaaagcagagcagaatgttccggaatcttcctgaggagttattgaattcattagcatcagaaaatctgactgcaaattttcacaagtggagcctgtctgtgaagaactttacagaaaacgagaagttaaagaagtttttcaatatattaacagtcaatacagatggcaagactgagttcatttcatccatggaaggatataagtatccaatatatgctgtccagtggcatcctgagaaagcaccatttgagtggaagaaactgcgaggcatttcccatgcaccgaatgctgtgaagacttcattttacttagcaaaattttttatttctgaagctctgaaaaatgatcaccactttgagaacgaacttgaagagactgaatccttgatttaccagttctgtccagtttatactggaaatatttcttcatttcagcaagcttatatgtttaactgaaagacttcaatatggtaacagagcaactttgagtaattccgtgattgaattgctaacactgctcagggcagtgtgagaaagccacacagatgcctttgctgtgtgcctggttctgattcatggcttaataatgattatttttatcagatttgataacccgacaatgaaaaagataaaaaaaaatcatagtgtttttagtgaaaatgccttcttaggtctgaagattctaaaaatacaagtttttg

SEQ ID NO: 293 - DNA, 1816 bp, Rattus norvegicus
ccccctcggcccgccatgctcctttcggtgccgctcctgcttggcctcctcggcctggctgccgcagaccctgccatctatttcaaagagcagttcttggacggagatgcctggaccaaccgctgggtcgaatccaaacataagtctgattttggcaaattcgtcctcagttctggcaaattctacggggaccaggagaaggataaagggttgcagacaagccaagatgcccgattttacgcgctgtccgccagattcgaacccttcagcaacaagggccagacactggtggtacagttcaccgtgaagcatgagcagaatatcgactgtgggggcggctacgtgaagctgtttccgggtggcttggaccagaaggacatgcatggagactcagaatataacatcatgtttggtccggacatctgcggtcctggcaccaagaaggttcatgtcatctttaactacaagggcaagaacgtgctgatcaacaaggatatccggtgtaaggatgatgaattcacacatctatacacgctgattgtgcggccagacaacacctacgaggtgaaaattgacaacagccaggtggagtcgggctccttggaggatgattgggactttctgccgcccaagaagattaaggatcctgacgctgccaagccagaagactgggatgaacgagccaagattgatgaccccacagattccaagcctgaggactgggacaagccagagcacatccctgaccctgatgctaagaagcctgaggactgggacgaagagatggatggagagtgggaaccaccagtgattcaaaatcctgaatacaagggcgaatggaagccacgtcaaattgacaacccagattacaagggtacctggatacacccagagattgacaatcctgaatactcccccgatgcgaatatctatgcctatgatagttttgctgtactgggcttagacctctggcaggtcaagtctggcacaatttttgacaacttcctcatcaccaatgatgaggcctatgcagaggagtttggcaatgagacctggggtgtcaccaaggctgcagagaagcagatgaaggacaagcaggatgaggagcagaggcttaaggaagaagaagaagacaagaagcgtaaagaggaagaggaggccgaggataaagaggatgaggatgacagagatgaagatgaagatgaagaggatgagaaggaagaagatgaggaggatgccactggccaagccaaggatgagctgtagaggccacaccacctgcctccagggctggactgaggcctgaacaccccgccacagagctggctgctcccaataatgtctctatgagactcaagaacttttcatttttttttcaggcaggttcaggtctggggtggattctgatttttgttcccctgcctccccatcctccccacccccctttttttttactggtgtttgtctttaattcttcagccctcacctcctggcctctcatttttgaatcaacattttttctttctgtccctttctccatctcttggtcactatcctccaactctaggaacaggtatggaggaaaagcctaggcttgagatttcatctgctctcctttctgaatctcagaggagggtaggagaagggggtggtatcttccctccccccagcactgaggaagaatggggctcttcccctttctcccttgcccccaggactgggccatttgtggggcagccagttctagcacagctcacactgagagtgtaagaactacaaacaaaatttctattaaattaagttttgtgtcttccca

SEQ ID NO: 294 - DNA, 544 bp, Rattus norvegicus
tttttttttttttttttaagttataaaaaaacccacttctttattgatcagcattggtaggagttttatataaaaatcaggcctgtggaatgtgaggggtgtggccaccccgtcggatggaagcactggagccagagccgcacagagccttgtgactggctgctttcacctgtgagggaatcgacaggacccgcacagacagctgtttagagggatgaggtccccgaggctctctctactccttggcaatggcaaagggtttctccacttcgatcttgccacagtctacaatgatcacatccttcaggggcttgtcccggctgtccgtcttggtgttctccaccttccgtaccacatccatgccttccagaactttgccgaaaaccacgtgcttgccgtctagccaggaggtcttgactgtagttatgaagaactgggagccattggtgtctttgcctgcattggccatgctcacccatccgggcccatagtgcttcagcttgaagttctcatctgggaagcgctcaccatagatgctctttcc

SEQ ID NO: 295 - DNA, 681 bp, Rattus rattus
gggatcagagtttctttatgggctataggggccacaaggctggccaggtggcaaggtcaccggtggcccggtcaccgatacaggtagtcagcctggatgttggccgcgatctcggcctcccacttgtcaccattgttgagtagcttctccttgttgtacagcaactcctcatgcgtctcggtggaaaactcaaagttggggccctccacgatagcgtcaacagggcaggcttcctggcagaaaccacagtacatacacttggtcatgtcaatgtcatagcgtgtagtccggcggctgccatctgctcttggctcagcctcaatggtgatggcctgtgcaggacagatggcctcacagagcttgcaggcgatgcaacgctcctccccagtacggtatcggcgcagtgcatgctccccacggaagcgcggactcagtgggcccttctcaaaggggtacttgatggtggccggctcccgaaatgagtacctacggtcatgcccagtctcggaagagtccgtcacatcagaaccgaactgcatgtcatcccagattctagtcaaaaaattcggtgccttcaatcaatactgttcgtacggccatgaagctagaggtttgcaataaaatccgtccaggccggcaaggcgggaaaatcaaccaggggaatctaataacccccgcaat

SEQ ID NO: 296 - DNA, 584 bp, Rattus rattus
aatgagtccttccaacgtttattataaaaggtgggtagcggcggtgagagggccagagggacgggaacctagacttatttgttcttcatgtagatctttggggtctgccagttctcaggggcttccttcaggcctgccttcagccagatgcgcttcaagtctttctcaaacttgatctgcttccttttcaaacgtccttcccggactttacgtcgtagaaaccgtgtcctcttgatcagtttacggtacttgtggtggttcatcttccgccttcggatcttcagcacatttttgcactgcattggagtggcatcccagacttccctgtctccctgtttggcttcctcctccccctggctaggtggacatttgtagaattgggagggagccagagtcactgggacctcaacattcagtctgggcaacaggtattgaacagtcagccagctctctagaggactgatggccatcttcctggggaccaggaactcttcaagctctaactgggccctcttaccagggagggaggcagcccgacttgggcttgcaggctgcaaactgtaaaggggtcgaaaagcatggct

SEQ ID NO: 297 - DNA, 1543 bp, Rattus rattus
cgtagaaactcaccattccctgcccaaccccagccccacacccagagcaatcaacagttccagatttgcgccagatcctgctccaaatccggtagccgcatcccaagccatggctggtcccttctcccgtctgctgtctgcccgccccggactcaagctcctggctttggctggagctgggtctctcgccgccgggattctgctccgtccggaatctgtacgagcggccaccggtgaacggaggagactgtatcccccgagcgctgagtacccagacctccgaaagcacaacaactgcatggccagtcacctgaccccagcagtctatgcacggctctgcgacaagaccacacccactggctggacactagatcagtgcatccagactggagtggacaaccctggccaccccttcatcaagactgtgggcatggtggctggagatgaggagacctatgaggtatttgccgaactgtttgaccctgtgatccaagagcggcataatggatatgaccctagaacaatgaagcacaccactgaccttgatgccagcaaaatccgttctggctactttgatgagaggtacgtattgtcctcaagagtcagaactggccgaagtatcaggggactcagtctccctccagcctgcactcgggcagagcgacgagaggtggagcgtgttgtggtggacgcgctgagtggcctgaagggcgacctggctggacggtactacaggctcagtgagatgacagaggctgagcagcagcagcttattgacgaccatttcctgtttgataaacctgtgtccccattgctgacagcagcaggcatggctcgagactggccagatgcccgaggaatctggcacaacaatgagaagagtttcttgatctgggtgaatgaggaggaccacacacgggtcatctctatggagaaaggcggcaacatgaagagagtgtttgaaagattctgccggggcctcaaaaaggtggagaagctgatccaggaacgaggctgggagttcatgtggaatgagcgtttaggatacatcttgacctgtccatctaacctgggcactggacttcgggcaggagtacacgtcaaactgccactgctaagcaaagatagccgcttcccaaagatcctggagaacctaaggctgcaaaagcgtgggactggaggagtggacacgcctgccacagcggatgtctttgacatctctaatctggatcgacttggcaagtcagaggtggagctggtgcagctggtcatcgatggggtgaactatttgattgactgtgaacggcgtctggagaaaggacaggatattcgaatccctccacctcttgtccacggcaaacattaactccccgtccccagcagctgaatcaagattccccaggacttctgcatatttaacagtggcccattctacttgccaaggacctgcctctcaatccctgtcctagtaaagactccacgttctgttgcaaaaaaaaaaaaaaataaagttcctatttctctgcaaaaaaaaaaaaaaaaa

SEQ ID NO: 298 - DNA, 3123 bp, Rattus norvegicus
ggcacgagctcgtgccgcggctgagaggaggcggcactgagtttccttgggagggcaacgcgttgggcgcgtctcccttccccctgtcctcccttttgcctccagtcttggacttggtagttgcatgcattggctcccgtcgaactaacagttctgaaggaggtagtggcgggcggaggtgatgcctgggagccctcccttgacagcccgggccgagaagagtctctgcaggaggtatcacccagactgacagatcatgctgacagcagcaggggaggctgagaagtgaaaggagccagctactgaggaggggctccagtagctcctaaagatcctatcaggacatggagtatgaaagacgaggtggtcgtggtgacagaactggccggtatggagctactgaccgctcacaggacgatggtggagagaaccgcagccgagaccatgattatagagacatggactatcgttcatacccacgagagtatggcagtcaggaaggcaagcatgagtatgacgactcatctgaagagcaaagtgcagagatccgtggccagctgcagtcccatggtgtccaagcacgagaggtccggctgatgcggaacaaatcctcaggtcagagccggggcttcgccttcgtcgagtttagtcacttgcaggacgctacacgatggatggaagccaatcagcattccctcaacatcctgggccagaaggtatccatgcattacagcgaccccaagcccaagatcaatgaggactggctgtgtaataagtgtggtgtccagaacttcaagcgccgagagaagtgcttcaaatgcggtgtgcccaaatcagaagcagagcagaagctaccccttggcactcgactggatcagcaggcactaccgttgggtgggcgggagctaagccagggcctactcccactgccgcagccctaccaggcccagggagtgctgacctcgcaagccttgtcacagggctcagagccaagctccgagaatgccaatgacaccattattttacgcaacctgaacccacacagcactatggattccatcctcggggccctagcaccctatgcggtgctgtcctcttccaatgttcgtgttatcaaggacaagcagacccagctgaaccgaggcttcgccttcatccagctctccaccatcgtggaagcagcccagctgctacagatccttcaggccctacaccctccgctcaccatcgatggcaagaccatcaacgtggagtttgccaagggctctaagagggatatggcctccaatgaaggcagtcgcatcaatgctgcctctgtggccagcactgccattgctgctgcccagtgggcaatctcacaggcctcccagggtggggagagtacctgggctgcccccgaggagccaccagttgactacagctactaccaacaggatgagggctatggcagcagccagggaacagattccctctatgcccatggctaccttaagaataccaagggccctggcatgactgggaccaaaggggacacatctggagcaggtcctgagacctcccttgagggtgggacagactctgtgtcactgcaggctttctctcgagcccagcctggtgctgcccctggactctatcagcaatcagctgaggggagcagtggccagggcactgctaccaacagccagtcatataccatcatgtcacctgctgtgctcaagtctgagctccagagccctactcatcccagctctgccttaccaccggccaccagtcccactgccccagagtcctacagccagtaccctgttcctgatgtctctacttaccaatatgatgagacatctggctactactatgacccccagactggtctatactatgatcccaactcccagtattactacaatgctcagagtcagcagtacctatactgggatggggagcggcggacctacatacctgccttggagcagtctgctgatggacataaggacacaggggcatcatcaaaggagggaaaagagaaaaaagagaagcataagacgaagacggcccaacagattgccaaggacatggagcggtgggcccgcagtctcaacaagcaaaaagaaaacttcaaaaacagcttccagcctattagtgctctacgagatgatgaaaggcgggaatcagccactgcagatgcaggctatgccatccttgagaagaagggagcactagctgaaagacagcacaccagcatggatctcccaaagttggccagtgatgaccgccctagcccacctcgagggctggtggcagcctatagtggagagagtgacagtgaggaggagcaggagcgagggggtcctgagcgggaagaaaagctcacagactggcagaagctagcctgtctgctctgccgccgccagtttcccagcaaggaggcgctcatccggcaccagcagctctctggactccacaagcaaaaccttgagattcatcgacgggcccacttgtcagaaaatgaattggaagcactagaaaagaatgacatggagcaaatgaagtatcgagaccgtgcagctgaacgcagagagaagtatggtatccctgagccaccagagcccaaacggaggaagtacggtggcatatctacagcctctgtggactttgaacagcccactcgggatggattaggcagtgacaacattggtagtcgaatgctccaggccatgggctggaaagaaggcagtggtctgggccgcaagaagcagggcattgtgacacccattgaagcccaaacacgtgttcgaggttctggcctgggtgcccggggaagttcctatggggtcacctcaacagaatcctacaaggagacactgcacaagacaatggtgacccgcttcaatgaagcccagtgaacaactttgaaagcagtttctacagacaaggggtattcatccagggacagagaagatgaggtctggaatggtctgaggaaggctcttctatctaccagcctgctgcccaaccagagaggccctcaccaaattagacttggagttgctgacttttgctgggaaattgggctcaaatcatgtttcttttgtaataaaatctaaaaagcctgcatcttccatt

SEQ ID NO: 299 - DNA, 440 bp, Rattus rattus
gaagtcatcgtcattataataaaattccccaaagcaaccaaccccaaagatcacgactctaaggtgattaaaagttacagggaacagaaggaaaagatcaggatgaaagagaacactatgggaaccacacagcatgtgaaggatgtaatgcctgactttcacagagctacacttaggagtcagaccatcagttatattacaagggaaccaataccaacatctctcccgtggagcacagtgattgataagcacatcatttttatggatatgtttaggatggaaagggacgggagaagcgagaggaggcaggaaggtgaaggtattatatacaaagagaaatgacagagactgcctcctcctttagctctttgcgctttctttttctttgttttccgcatcctctggatacgcatgccacgtcagtctctcttcataaaatg

SEQ ID NO: 300 - DNA, 466 bp, Rattus rattus
cccagctttttaagttgcatttatttttgataatctgtactgtagccaatcaattctattctccattcttgcttaattgtattagccataaaggagttcaggttcataggactcagtttctctattaaaccgtcattgattatggaaatactgtcttaagcactatgcagattaacaccatacttttcttccattacatctttcaagacagtcactcacaactcagaagactgatacagcattagatgaaaaaaacaagattcacagatatatgtagtgaaactcaaactaggagtcttagagataaaaaagataagtagatatttaaaatgtagtctgttaaagatttaatcggtttaaagtataagattagaaagacaaagtttctattgttttgaaagttttaagtaaagaaaaaaaaaactggaaaaaatgtctttgttgttctttctccgttcttaattac

SEQ ID NO: 301 - DNA, 1110 bp, Rattus norvegicus
gacacggaggtcttcagcacccacagagggacttacaggtcggatcataaggcaaccttctgtcagtctgctctgccccttctcttgtggagcaccctgccttgctgactttctctgcctgtgataggtggtgtcgtttcccccccacctaagttctggcaggtacactgctggccagcagcagatgcccacgaagatgctgacagtgaagacgctggccctgtgcttgattcttgctaagtcagcctggtcggaagatcaggataaggtggtacatggaggcccctgtttgaagaactctcaccctttccaagctgccctctacacctcgggtcacttgctgtgtggtggggtcctcgtcggcccacagtgggtgctgacagctgcccactgcaaaaaaccgaatctggaggtgtacttggggaaacacaatctacggcaaactgagactttccaaaggcaaatctctgtggacaggactattgtccatccccgttacaatccccaaacccatgacaatgatatcatgatggtgcatctgaaacgtccagtcaaattctctcaaaggatccagcccctgcctttgaagaaagactgctctgagaagaatcccgactgtcagatcctcggctggggcaagatggaaaacggtgaattcccagataccatccagtgtgctgatgtccagctggtgtcccgggaagagtgtgagcgcgcctaccctggcaagatcacccgaagcatggtgtgcgcaggcgacaagagagaagggaacgattcctgccagggtgattctggaggtcccctggtatgcggtggtcacctccgagggattgtgtcatggggtgacatgccctgtggatcaaaggaaaagccgggagtttacacagatgtctgcactcatatcagatggatccaaaacatcatcagaaacaagtgactctggcatgagacatgcagttcttgacctgtctctcccctgaccctagctggctacatattctctctccctgaaaccctgccccactctcagagccttcagatgtccagctctgccccctcatgcttaataaatgcagtgaaaaaaaaaaaaaaaaaaaaaaaaaaaaa

SEQ ID NO: 302 - DNA, 6335 bp, Rattus norvegicus
catttgcagcacatttttggctttccctccccctccatacattccccccctcctttttcaatttttcttcttcccgggaagtgaattgctgatgccaaggggactttaattccattaatgatgcaactggattcgtttcaggattatgttgcacgaattgaattttgaatgaaggaggttttttttttctttttgaaagaagtgttgattctttagttcgttgtacttttaattattattttatttaaatatacaatttaattgtattattctcttaaaaatattaaatctatattttatggaaacttaccctcaaaatatatatgtttatgggtgaaattgaagacgcttccgttaagtgaggtgactggtgtattggatgtttaattgagcaccggcattgcatgacagttgttgaataacaagtggtttatttttaaaaaccacatctttaaaattttaggttcagatagtaacagtagacatcgtaagggcatttaaaagaaaaccagcagaaatcgaagcaaacatgtctggagaagtgcgtttgaggcagttggaacagtttattttagatgggccagctcagaccaatgggcagtgcttcagtgtggagacgttactggacatactcatctgtctttatgatgaatgcaataattctccattgagaagagagaagaacattcttgaatatctagaatgggctaaaccattcacttctaaagtgaagcaaatgcgcttacatagagaagacttcgaaatattaaaggtgattggtcgaggagcttttggtgaggttgctgtagttaaactgaaaaatgcagataaagtatttgccatgaaaattctgaacaagtgggaaatgctgaaaagagctgagacagcgtgctttcgtgaagagagggatgtgttggtaaatggagacagtaagtggataaccactctgcactatgcttttcaggatgacaataacttatacctggttatggattattatgttggtggggatttacttactctgctcagcaaatttgaagatcgattgccagaagagatggctcggttttacttggctgagatggtgatagccattgactcagttcaccagctccactatgttcacagagacatcaaacctgacaatatattgatggatatgaatggacatattcgtttagcagattttggttcttgtctgaagctgatggaagatggaacggtccagtcctcagtggcagttggaactccagactacatttccccggaaatccttcaggctatggaggacgggaaaggcagatatggaccagagtgtgactggtggtccttgggagtctgcatgtatgagatgctttacggagaaacaccattctatgcggaatctctggtggagacatatggaaaaattatgaatcataaagagaggtttcagtttccaacccaagtgactgatgtgtctgaaaatgctaaagatcttattcgaagactcatttgtagcagagaacatcgacttggccagaatggaatagaagactttaagaaacatccgtttttcagtggaattgattgggataacatccgaaactgtgaagcaccttacattccagaagttagtagtccaacagacacgtcaaatttcgatgtggatgacgactgtttaaaaaactctgaaacaatgcccccaccaacacatactgcattttctggccatcatctaccatttgttgggtttacatatactagtagctgtgttctttctgatcggagctgtttaagagtcacagcaggtcccacctcactggatcttgacgtcaatgtccagaggactctagataataacttagcaactgaagcttatgaaagaagaattaaacggctagaacaggaaaagcttgaacttactagaaaacttcaagagtcaacacagactgttcaagccctgcagtattcaactgttgatggtccactaacggcaagcaaagatttagaaattaaaagtctgaaagaagagattgaaaaactaagaaaacaagtagcagaagtgaatcatttggaacaacaacttgaagaagctaattctgtgagacgagaactagatgatgcttttaggcaaatcaaagcttttgaaaaacaaatcaaaactttgcagcaggaaagagaagagctaaataaggaactagtccaggctagtgagcgattaaaaaaccaatccaaagagctgaaagacgcacactgtcagaggaaactggccatgcaggagttcatggagatcaatgagcgactaacagaattgcacacccaaaagcagaaacttgctcgccatgtccgagataaggaagaagaggtggacctggtgatgcaaaaagctgagagcttaaggcaggagcttcgcagagcagaaagagccaagaaagagctggaggttcacactgaagctctaattgctgaagcctcaaaggaccggaagctccgagagcagagcagacattattctaaacagctggaaaatgaattggagggactgaagcaaaaacaaattagttactcaccaggaatatgcagcatagaacaccagcaagagataactaaactgaaaactgacttggaaaagaaaagtatcttttatgaagaagaaatctctaaaagagaaggaattcatgcaagtgagattaaaaatctgaagaaggagctgcatgactcagaaggccagcaacttgctctcaacaaagaaattatggttttaaaagacaaattggaaaaaaccagaagggaaagtcaaagtgaaagggaagaatttgaaaatgagttcaagcaacaatatgaacgggaaaaagtattattaactgaagagaataaaaagttaacgagtgaactcgataagctaacttcgttgtatgagagcttaagtttgcgcaaccagcacttagaagaagaggtcaaagatctagcagataagaaggaatcagttgcccactgggaagcccaaatcacagagataatccaatgggtgagtgatgagaaggacgcacggggctatcttcaggccttagcttctaaaatgactgaagaattagaagcgttaaggaattccagcctggggacacgagcgacagatatgccctggaaaatgcgtcgttttgcaaaactggacatgtcagctagactagagttgcaatctgccctggatgcagaaatcagagctaagcaggccatccaggaagagctgaataaagtcaaagcatccaacatcataacagaatgtaaactgaaagattcagagaagaagaacttggaactgttgtccgaaatcgagcagctgataaaggacactgaagagcttagatctgaaaagggtgtagagcaccgagactcacagcactctttcttggcatttttgaatacgcctaccgatgctctggatcaatttgaacgctctccgtcctgtactccagctggcaaaggcagacgtattgcagactctgctccgcttccagttcacacaccaactttaaggaaaaagggatgcccagcttcagctggttttccacctaagcgcaagactcatcagtttttcgtgaagtctttcactgcccctaccaagtgccatcagtgtacctccttgatggtcggtttgataagacagggctgttcctgcgaagtctgtgggttctcatgtcatataacttgtgtgaacaaagccccgaccacttgcccagttcctcctgagcaaactaaaggcccactcggtatagacccccagaagggagtagggacagcgtatgagggccatgtccggatccctaagccggcgggagtgaagaaagggtggcagagagcactggctgtggtctgtgacttcaaactgtttctttatgatatcgcggagggaaaagcatcgcagcccagctccgtcattagtcaagtgatcgacatgagagatgaagaattttccgtgagttcagtcttggcttctgatgttattcatgcaagtcgaaaagatattccctgtatatttagagtcacagcctcccagctctcagcacctagtgacaaatgttccatcctgatgctagccgacagcgagactgagaggagtaagtgggtgggagtgctgagtgaactccacaaggttctgaagaaaaacaagttcagagaccgctcagtgtatgtccccaaagaggcttacgacagcactctacccctcattaaaacaacgcaggccgcggcaatcatagatcatgagcgggtagctttgggaaatgaagaaggattatttgttgtgcatgtcactaaagatgagattattagagttggtgataataagaaaattcatcagattgaactcattccaagtgaccagcttgttgctgtgatctcaggccgaaatcgccacgtccgacttttccctatgtcagctttggatgggcgagagacggatttttataaactggcagagactaaagggtgtcaaaccatagctgctgggaaggtgcgccatggagctctgtcctgcctgtgtgtggccatgaaaagacaggtcctctgctatgaactgttccaaagcaagaccaggcacaggaagtttaaggagattcaagtcccatgtaatgtccagtggatggccatcttcagtgaacatctctgtgtgggattccagtcaggatttctcagataccccctgaatggggaaggaagtccatgcaatatgctccattcaaatgaccacacactggcattcattacacaccaaccaatggatgctatctgtgccgttgagatctccaacaaagagtatttgctgtgttttagcagcattgggatatacacggactgccagggccgaagatctagacagcaggaactgatgtggccagcaaatccttcctcctgttgttacaatgcaccatatctctccatttacagtgaaaatgcagttgatatctttgatgtaaactccatggaatggatacagacgcttcctctcaagaaggttcgacctttaaacactgaaggatcattaaatcttttagggttggagaccattagattaatatatttcaaaaataagatggcagaaggggatgaacttgtagttcctgaaacatcagataatagccgaaaacagatggttagaaacatcaacaacaaacggcgttactccttccgggtcccagaagaagagaggatgcagcagagaagggagatgctacgagatccagaaatgagaaataaattaatttctaacccaactaattttaaccacatagcacacatgggtcctggagatggaatacagatcctaaaagacctgcccatgaacccacggcctcaggaaagccggacagtattcagtggctccgtcagtattccctccatcaccaagtcccgccctgagccaggccgctccatgagtgccagcagtggcctgtctgcacggtcatcagcccagaatggcagtgcgctaaagagggaattctctggaggaagctacaacacgaagcgacagcccatgccctctccctcagaaggctctttgtcatcaggaggcgtggaccaaggaagtgacgcccccgtgagggactatgatggagaggactctgattctccaaggcattccacagcttccaacagctctaacctgagcagccccccaagccccgtttcaccccgaaagaccaagagcctctccttggagagcacagaccgtgggagctgggatccatgagcaggaccagtgactccaggcagggaccctgccctcccactctgacaacgcgcctggcagcagcatcaccttccacactgcctgccaccgaggattccttcacagccaggcccgcttcacccttcccccaacccccaggtagcttctgtagacagactgcgcagacgcagcgctaagagtagaccggttgtgttctcaccgtagccctcacgtagccctcacgtagcgcccagcagcctccatgagcgtcagctgactgttgccaggaaataaaccctcatgaattaaaacaatgcatatttttactacaataaagagtttaaataaatacatagatgtagacgttaaatactgaagtataaatagtcaaagaagcatctcttgtgttcgatgaaagatggatgcgatataagaaagatcatttaatttaaaaaaaaaaagtgttgtttcttatctgtttcccagctaagtcataatacagggtagaaaggcctcaagtgacatttataaagacacagaagtcaggtcccggtggtgtctgtcctcaagcctaggcagctgtggtcacagggaagtctaatgtctggagattactcgtgccgaattc

SEQ ID NO: 303 - DNA, 1482 bp, Rattus norvegicus
gaattcgggttccgtctacttcagccgcagcgtctccctgcctgtctcattgcattctccagagaggggacggacctccacttcctctttcagaaaaatgtctgctccagctcagccacctgctgaagggacagaaggggctgccccaggtgggggtcctcctggtcctcctcccaatacgaccagtaacagacgattacagcaaacccaggcacaagtggaggaggtggtggacatcattcgcgtgaatgtggacaaggtcttggagagggaccagaagttgtcagagttggatgaccgagctgacgccttgcaggcaggagcgtcagtgtttgagagcagtgctgccaagctaaaaaggaagtattggtggaaaaactgcaagatgatgatcatgctgggagctatctgtgccatcatcgtggtagtaattgtaatctacatttttacttgagaatgtgccatcccttccctgttctccattgccatccaagctcatgtttcccctctgtttgctctctcaacaaagtcctccatcttccgttctccatcctggcccaggcttctctgtgatccgaccttccctttttgtgcattcattcgcactcttcctcaaaactagaaatgctgctcgtggcacagtcctgaaagtcactgcccgaagagaacacccagcacctcctctttacccatttatcatgtgccctggagcttaaaagagttgtggccaatggcagaggtgaagtgtctgagaagttagcatggctgaggggaagagaaaggcatttgtgtccaagaaaggctggcctttggcaggagggaagcaagaatagttgggaagtagtagcttgctgccagtgtatatgtatatgtatatgtatatgtatatgtatatgtatatgtatatgtatatattagttgggaactatgacctgctgtcctcatttggaactttcctcccataccaggcctgtcttgggtcccagaggtctgtttaaagaccaacttcaaatcccttttagaaaaacatcaaacttgcattttgtagctactgttatctgtcagtacaagattttctgtgtctttgggggaactttacaacttttcgctttgtctctatagccccaggagagaagtactttctgattttaaaaacagcaggacactcttaccttcttctagaaggcgtcccacatgcttctgactagaaggagctaccacctcttcatgtcatctgaagcatttgatgttgttcatgaaggcaccaaataatttcagggaatgaggggctttgaggataacaggctctcaggaacacgctccatgccatcccactctccaatgaaagccctgtacctcccttgttgattaagagaaatgagagttatatggtgagactcccagggtcccacagaacacttccccctgcactacccacttactgtgtgtaagacaaggatgaggcaggagggccccgaattc

SEQ ID NO: 304 - DNA, 595 bp, Rattus rattus
  misc_feature (3)..(3): n is a, c, g, or t
ganagtcatacaagtataatttatagtttctcagaagaataaaacactgaatgtcttttctctagttagcaaagattgtttcttcctttgccccagacaaatggcagtcaatgatttgggattaaaacaaaacacatcaggtattcccctaaggaatctataataaagacacataactttttcattcataattaaacagttcaattacttctccctcaattaggtaatactctccctttacaaaactatagtactagttaagcctacatttttcttaaatgaacttttaatttttatctgtataggttacacaagtctagttggcacaccttaagaataacgcaaaatacgttattctttaagagaattatgagactatcaatttttaaagaataatcccagatacttaattcaataaacaaatttcttcccatcagcagtagcgatttttaagtgatcgttaaatgctcacctgaagattatcaatgccatatggagtgtaaacttgttttgaaggtttacgtacattttgtaagccagaacttgtactgagggttttaagaagataacctacaaacatatctgccccatgaaa

SEQ ID NO: 305 - DNA, 631 bp, Rattus norvegicus
ctgttagcggccagaggtgacctgtgaagatggttcgctactcccttgacccagaaaaccccacgaaatcatgcaagtcaagaggctcaaaccttcgtgttcactttaagaacacccgggaaactgcccaggccatcaagggtatgcatatccgcaaagccaccaagtatctgaaggatgtcactttaaagaagcagtgtgtgccattccggcggtataacggtggagttggtaggtgcgcccaggccaaacagtggggctggacacagggacggtggccaaaaaagagtgctgaatttttgctgcacatgcttaaaaatgcagagagtaatgctgaacttaagggtttggatgtagactctctggtcattgaacacatccaggtgaacaaggctcctaagatgcgcagacggacctacagagctcacggccggattaacccatacatgagctccccctgccacatcgaaatgatcctcactgagaaggaacagattgttccaaagccagaagaggaggttgcacagaagaaaaagatatcccagaagaaattgaagaaacaaaagctcatggcacgggaataaattcagcataaataaatgcggataaagtaaaaaaaaaaaaaaaaaaa

SEQ ID NO: 306 - DNA, 3256 bp, Rattus norvegicus
cacgaggcgactgggggcgcggaagggaggcgaggttccgggggtggggcggcccggaggcgagcgggcgagcggggccgccgagcggcggcgagagggcaggcggcggcggccgaggcggagagagcggcgcggggtgcggccgccgagaggagctcctcccccgtcccctcaccccctcagctgagctcgagtcggggcggggcggggtacgtggagcggggccgggcggggagctgctccgagtctggccggagcgcacccggggcgcccgcgttcgccgctcgcgggaactttgcggcggacggtgtggaggccgcggaggggtgcatgagcggcgcagggcggcgcacagagcggcggctgtccggtccggcccctgctggagtcgccgccggaggaggcgagcgaggagccaggtgtgtgtgccttcttcctgcttctggaaaaaatgccggtccggaagcaagatacccagagagcattgcatctgttggaagaatatcggtcgaaactaagccaaaccgaagacagacagctcaggagttccatagagcgggttattagcatatttcagagcaacctctttcaggctttaatagacattcaagaattttatgaagtgaccttacttgataatccaaaatgtgtggatcattcaaagcagtgtgaaccggtccaacccgggaatccttgggagagtggcagcctttcaagtgctgctgtgacttcagagagcctgcccggcggccttagccctccagtagagaaataccggtatcaggacgaagaggtgctgccttcagagcggatttccccgcaagtcccaaatgaggtgctgggtccggagctggttcacgtctcggagaagagcctgtcagagattgagaatgtccacgggtttgtctctcactctcatatctcacccataaagcccacagaagctgttcctccctcctctcccattgtccctgtgacccctgccttgccagtccctgctgagagtcctgtcgtcctgccctccacaccacaggcaaatcctcctcctgtcctggtcaacacagacagcttggagacaccaacttatgttaatggtactgatgcagattatgaatatgaggaaatcacacttgaaaggggaaattcaggcttgggtttcagcattgcaggaggtacagacaacccacacattggagatgactcaagtattttcatcaccaaaattatcacgggaggagcagctgcccaggatggaagattgcgggtaaatgactgtatactgagagtaaatgaagcagatgttcgtgatgtaacccacagcaaagcagttgaagcattgaaagaagctggatcgatagtgcgattatatgtgaaaaggcggaaggccttcagaaaaaatcatgaaataaaacttattaaaggccctaaaggtcttgggttcagcattgctggaggtgttggaaaccagcacattcctggggataacagcatctatgtaaccaaaataattgaaggaggtgcagcacacaaggacggcaaacttcagattggagacaagcttctagcagtgaacagtgtctgtttagaagaagttactcatgaagaagcagtgactgccttaaagaatacatctgattttgtttatttgaaagcggcaaaaccaacaagtatgtatataaatgatggctatgcaccacccgacatcactaattcttcttctcagtctgttgacaaccatgttagcccgtcttcatacttgggccagactccagcgtcaccagccagatactcacccatttctaaagcagtgcttggagatgatgagatcactagggaacctagaaaagttgttcttcatcgtggctcaacgggacttggtttcaacattgtgggaggcgaagatggagaagggatttttatctctttcatccttgctgggggacctgctgacctaagcggagagctcagaaaaggagatcgcattatatcggtaaacagtgttgacctcagagctgcaagtcatgaacaagcagctgccgcattaaaaaacgcaggccaagctgtcactattgtcgcacagtatcggcctgaagagtacagtcgttttgaagctaaaattcacgacttgcgggagacgatgatgaacagcagtgtcagctcagggtcagggtctctccgaaccagccaaaagcggtccctctatgtcagagccctttttgattacgacaagactaaagacagtggccttcccagtcaagggttgaacttcaaattcggagatattctccatgttatcaatgcttctgatgacgagtggtggcaggccagacaggtgaccccagatggtgagagtgacgaagttggagtaattcctagtaaacgcagagttgagaagaaagaacgagcccgattaaaaacagtcaaattcaattctaaaacaagaggagataaaggggagatccctgacgacatgggatcaaaaggcctgaagcacgtaacttctaatgccagcgatagcgaaagtagttaccatgaatatggctgctcaaaaggtggtcaagaagaatatgttttatcgtatgagccggtgaatcagcaagaagttaattatacccgaccagtcatcatattaggacctatgaaagacagagtaaatgatgacttaatctcagaatttcctgacaaatttggatcctgtgtccctcatacaactagaccaaagcgtgactatgaggtggatggacgagattaccattttgtgacttcaagagaacagatggagaaagatatccaggagcataaattcattgaagctggccagtataacaaccatctatacggaacgagtgtccaatctgtgcgagcagtagcagagaagggcaagcattgtatccttgatgtgtctggaaatgccatcaagaggttgcagattgcacagctctatccaatatctatttttattaaacccaaatccatggaaaatatcatggaaatgaataaacgcctaacagacgaacaggccagaaaaacgtttgagagagcagtgagactggagcaggagttcactgagcatttcacagctattgtccagggagacacgctggaggacatttacaatcaagtgaagcagatcatagaagagcagtctggtccttacatctgggtcccagcaaaagaaaaattatgaagacagatgttgctctttctttttccatggtctcatctctctgccctgctctggaggtctgtcttcagc

SEQ ID NO: 307 - DNA, 418 bp, Rattus norvegicus
  misc_feature (325)..(325): n is a, c, g, or t
tttttttttttttttttaaatacaaaagttcttttatgaaaaaaagctgagacccacaaagtgcttagcagtcagaggccgacagacaagctcttattgagttgggattactagtgctgttattgttgggggaggggatagccaccttttctcacctgtgatatgggaagataatcggaatggctttctgtctgggaaagcaggacttgctgttaaaaggctacagtatatgttgtaactacaggaagacaatttggtttaaaaatcacactgaatacatctcaatgtacacatcataaggttcattcggatctaaatagtgcanagaaaaaaggctattcttcaaaaagaaaaaccgaaagcagcaagccgtaccaaccctcatccagtatgtcagcagtatctatgctgctgttta

SEQ ID NO: 308 - DNA, 678 bp, Rattus norvegicus
atgccggtcaaaggaggtagcaagtgcatcaaatacctgctctttggatttaacttcatcttctggctcgccggcatcgcagtgcttgccattggactatggctgcggttcgactctcagaccaagagcatcttcgagcaagaaactaatcattccagcttctacacaggagtgtacattctgattggagctggggccctcatgatgctagttggtttcctgggctgctgtggagctgtacaagagtcacagtgcatgctgggattgttcttcggattcctcttggtgatattcgccattgagatcgccgcagccgtctggggctatacccacaaggacgaggtgattaaagaactccaggagttttacaaggacacctaccaaaagttaaggaacaaggatgagccccagcgggaaacactcaaagccatccatatggcgttgaactgctgtggcatagctggtggtgtggagcagtttatctcggacatctgccccaaaaagcaggttctggaatccttccaggttaagtcctgcccggatgccatcgatgaggtcttccacagcaagttccacatcattggagcagtgggcatcggtatcgccgtggtgatgatcttcggtatgattttcagcatgattctgtgctgcgccatccgcaggagccgagaaatggtc

SEQ ID NO: 309 - DNA, 705 bp, Rattus norvegicus
tgagagcgagacaagctgggaatgaagtcctggttgccagatgggagcttgaaaacacagtaagatgagtcaaaaagtggccaaggagggccccaggctctccaagaaccagaagttctcagagcacttcagcatccactgctgcccacccttcaccttcctcaactccaagcgtgagatcgtggaccgcaagtacagcatctgcaagagcggttgcttttaccagaagaaggaggaggactggatctgctgtgcctgccagaagaccagccgccgtgccacatcccctcagaagcccaagcaccagccagctgcatcccctgtggtggtcagagcgccgccagccaagccaaagtcccctccgaggccagccaagccaaggtcccctccgattccagccaagccaaggtccccttcaaggactgagcgccagccgcgtccccgcccagaggtccgaccaccaccagccaagcagaagccccctcagaagtctaaacagccagcacgaagcagccccctcagagggccaggcaccagccgcggggggtctcccaccagagctcctaggttctggtaacaccatctcttgccttttgtcccccctagcctaaggtcagtagctgctctctgcaagtactaacatgggggatctctccacagtaccaagctgtgtaatctactcctgcattaaaccccctctgtttg

SEQ ID NO: 310 - DNA, 2207 bp, Rattus norvegicus
gtctcccggctgtgcttggccgtgcggagggccggtgccagcacctccagctccgggacagcagcgggagccaagcccgagccgcaggcgtcgtcgccatgcgctggttccgggcgctgttgaagaatgcgtccctggcaggggcgcccaagtacatcgagcacttcagcaagttctccccgtccccgctgtccatgaagcagtttctagacttcggatccagcaatgcctgcgagaaaacttcattcaccttcctccggcaggagctgcccgtgcgcctggccaacatcatgaaagagatcaacctgcttcctgaccgggtgctgagcaccccctcagtgcaactggtgcagagctggtatgtccagagtctgctggacatcatggaattcctggacaaggaccccgaggaccaccggaccctaagccagttcactgatgccctggtcaccatccggaaccggcacaatgacgtagtgcccaccatggcacagggagtgttggagtacaaggacacctatggtgatgacccagtctccaaccagaacatccagtactttttggaccgcttctacctcagccgcatctctatccgcatgctcattaaccagcacaccctcatctttgatggcagcaccaacccagcccaccccaaacacattggcagcattgatcccaactgcagcgtgtctgatgtggtgaaagatgcctatgacatggctaagctcctgtgtgacaagtattacatggcttcccctgacctggagatccaggaagtcaatgccaccaacgccacccagcccattcacatggtctacgtcccctcccacctctaccacatgctctttgaactcttcaagaatgccatgcgggccacagtggaaagccacgagtccagcctcactctccctcccatcaaaatcatggtggccctcggtgaagaagatctgtccatcaaaatgagtgaccgaggcgggggtgtccccttgaggaagatcgagaggctcttcagctacatgtactctacagctcctacaccccagcctggcactgggggtaccccgctggctggctttgggtatggactccccatttcccgcctctacgccaagtacttccagggggacttgcagctcttctctatggagggctttgggacagatgctgtcatctatctgaaggccctgtccacggactcagtggagcgcctgcctgtctacaacaagtctgcctggcgccactaccagaccatccaggaggccggtgactggtgcgtgcccagcacagagcccaagaacacatcgacgtatcgggtcagctaggggccttctcttcctggcacctgggaggatgctgccacctctgaatccagccaccacagggacttccctatctatcccctggggtacgggggtgaaactgggtctccccgatggccagatctgtctttgtagaaatcgcagtggcccatctgtggcgatccctaagtgccaatctgtctctatggagaaacctagggggtttccctggagcctggtctccatggtgatgatgcttgagggttggggacggctctacctggtggggtggccccagagacacttctcccaagaccagagctgtctgttttctaccagaaaccctgggtccccctcactgcctgcatagtcctggtctcccacgtggctgcctcgcttgccttatgcccacaccctgtacaggcacattgggctggtttcttcgtcagtagtaagaaagatggagagagactggggaaacgggggccaaccttgtctctggtcctgcagcctctctccatctccactctggacactaaagttgccactgggaacttgagaatgggtggccgttctcacccaaggcccaccgagaaggcctaagagtaacctgtccccaaggcgatcttagcaatgtttctgccgcttcctggcctggcatgtcctcacgtgtatacctcccctgcccagtgtacgctcaccctatccctgcttgagctttagaccccagacttcctatgcccactatgtgtgcacagacgactcaaacccaggatgccccatgtacatagccagttttgtaatctcagatgcctcacccttgccctccgcacacaggggttaaagccgtgtgcccctcccagtggctgggatggtgacagtgacatccacagtaaatagatgaaatga

SEQ ID NO: 311 - DNA, 1109 bp, Rattus norvegicus
gaattccctgctgcaaacatggcgctgctggcccgtgcgttctttgctggggtgtcccgcctcccctgcgatcccggtcctcagaagtttttcagctttggaacgaaaaccctgtatcaaagcatcgatgctccacagtctaaattcttcccacccattttaaagcctatgctaccacctaatgcctttcaaggaaaagtggctttcatcacgggaggaggcactggccttggcaaggcaatgacaactttccgctccagcctgggtgcccagtgtgtgatcgcgagcaggaatattgatgttctgaaagctactgcagaagagattacttctaaaactggaaataaggtctatgcgattcggtgtgacgttcgagatcctgatatggtacacaacacagtactggagctgatcaaagttgcagggcatcctgatgtggtgataaacaatgcggcagggaacttcatttctcccagtgagagactgtctcccaatggttggaggaccataactgacatagttctcaatggtacagcctatgtgacgatagaaattggaaagcagctaattaaagcacagaaaggagtcgcctttcttgctatcactacgatctatgctgagagcggatcaggctttgtaatgccaagttcttcagccaaatcaggcgtggaagccatgaataagtctcttgcagctgaatggggtagatacggaatgcgtttcaacataattcagccagggcctatcaaaaccaaaggtgcctttagccgtttggacccgactggaaaatttgagaaagatatgatcgagagaatcccctgtggtcggctgggaactgtggaggaacttgccaatctagcgactttcctttgcagtgattatgcctcttggatcaatggggcagtcattcgatttgacggtggagaggaagtgtttctgtcaggtgaattcaactctctaaagaaggtcaccaaggaggagtgggatgtaatcgaaggcctcatcagaaagacaaaaggctcctaagacgttcatggcttcctctgtgacaaactaaagtttagggactatatagatggacatttgagttaataaattttttgtctgat

SEQ ID NO: 312 - DNA, 620 bp, Rattus norvegicus
tttttttttttttttttaagggttgtatgtttatttaaaaaatttaaagggaaaatatatgtgcaaattaagtaaagacagaagcaggcagaaaggggctcttctgtgtactgcaaactctaataactctggggccatactaatacataccctttgggatttctaatcatccacccttcccattaatattgtatgccttcactatgaaaactgttaacaaaacttgcttcataaagttttattgatggcatttatcccatggtttaacatgttaattatactgtaataaacatggctttaatattaaactttttccttattatccaaagtcaccacagtccatttcagtaaatataaaaatatatgcttaatactttgtacaatactggtttttggtccaaacaaaactggatcagaaaagccaataaattcaactttaagaatccccaatttttttttaaagatttccaaatggatttaggcaactttgaataatgggatttacataataaaatctgagacaagactaaacaaacaacaaaaatatgtctaacataaaattaaaatttcaagttcacagatttatgttatgccaaaaaagtacagaaacaaaattgtat

SEQ ID NO: 313 - DNA, 1500 bp, Rattus norvegicus
taaccgcgccaaccgccaccgaggtgcccggagagaggcggagaggcggcatgagcgaggcgggcgaggccaccaccggcggcaccacgcacccgcaggccgcggccgacgcgcccgccgcggcgcccccggaccccgcgcctaagagcccggcggccagcggcgcgccccaggccccggcgcccgccgcgctgctcgcgggagccccggcgagagccagcccccgggcccgccccggcctcatcagcccccgcgggaagcgaggacgcgagaagaaagttctcgccaccaaagtccttggcactgtcaaatggttcaacgtcagaaatggatatggatttataaaccgaaacgacaccaaagaagatgtgtttgtacaccagactgccatcaagaagaataaccacgtcaagtatctgcgcagtgtgggggatggagaaactgtagagtttgatgtggttgaaggagaaaagggtgctgaagcagcaaatgtgactggcccagatggagttcctgtagaagggagtcgctatgctgctgatcggcgccggtacagacgcggctactatggcaggcgccgaggacctccccgtaatgctggtgagattggagagatgaaggatggagtccccgagggagcgcagctccaggttcatcggaatcccacttaccgcccaaggttccgcaggggacctgctcgcccacgacctgcccctgctattggagaggctgaagataaagaaaatcagcaagcggccaatggtccaaaccagccgtctgcccgccgtggattccgacgcccctacaactacaggcgccgcccccgtcccctcaacgctgtttcacaagatggcaaagagaccaaggcaggtgaagcaccaactgagaaccccgctccagccaccgaacagagcagtgccgagtgaccctggctcccaggcaccttcaccaccagcagggtgaccttaagaattaatgaccattcaaaaacaaggcaaaaagcacacccacgaccttaccaacaccaaagaaacatctaagcaataaaacggaagactaacaagatttggacattagaatgtttactgctattctctacgaaactaacaactgcaaagggaaggagcccgcactgtccatcaagctgcgtcccgggaacctgcacaggcagagagcagcctccccatttcagcaacctagtgctttatatttttttcctggtttttactgttttggtaatatgaattaaaagaagaaatattaataccacatggggattgccccaaccaaagaaatctgaaatatatagtaaatgctctttttcctttgttgttcattttggatgctggtgctaaacttccaagtgtcatgatttaagaagaaattttatgcccttatttattcctaggatgaggggagaacatttttgctttcttacatagctctctctgaaatgtgcagtaacaagttcctcaaaaataaaatttttaccttcaaaga

SEQ ID NO: 314 - DNA, 1934 bp, Rattus norvegicus
cctataagccggcgacctctggcattaagctttgctctcttcgggccgtcgcgaccatgcagacccccggcgtcttgctgctcattctcggcctcctggatgcgtcctcctccgcgcttatcagaatccccctgcgcaagttcacatccatccgtcggactatgacggaagtgggaggctctgtggaagacctgatccttaaaggtcccataaccaagtactccatgcagtcatctcctaggaccaaggagccagtgtcagagttactaaaaaactacctggatgcccagtactatggtgagatcggcattgggactcccccacagtgtttcacagtcgtctttgacactggctcctctaacctgtgggtcccctccattcattgcaagctgctggacatagcctgctgggtccaccacaagtacaacagtgacaagtccagcacctatgtgaagaatggcacatccttcgacatccactacggctcaggtagcctctctgggtacctgagccaggacactgtgtcggttccatgtaagtcagacttaggaggtatcaaggtggagaaacagatctttggggaagccaccaagcagcctggagtcgtattcatcgcagccaagtttgatggcatcttgggcatgggctacccttttatctctgttaacaaggtgctcccggtcttcgacaacctgatgaaacagaagctggtggaaaagaacatcttctccttctacctgaacagggacccaaccgggcaacctggaggagaactaatgcttggcggcactgactccagatactaccacggggagctgtcctacctgaacgtcacccgaaaggcctactggcaggtgcacatggaccagctggaggtgggcagcgagctgaccctgtgcaagggaggctgtgaggctattgtggacacagggacgtctcttctggtggggcctgtggacgaggtgaaggaactacagaaggccattggggcagtgcctctcatccagggcgagtatatgatcccttgtgagaaggtgtccagcctgcccattatcacctttaagctaggaggccaaaactatgaactacacccagagaagtacatactcaaggtatcgcaggctggaaagacgatctgcctgagtggcttcatggggatggacataccccctcccagtgggccgctctggatcctgggcgatgtctttattggctgctactacaccgtgtttgacagagaatacaatagggtcggctttgccaaggctgccacactctaacttgctccttcttcactgtcagggaactggatcagagtccagtagagaaagccagccagccccatccctccacctgccccactcacacatattcacactcgcctagtgttgctgggcccttgggaggcctggctggagctggtccagctgttctgttctgtggtccctgtccctgggttcagattgctgccctccgcctgtctgaaggaggccaaggcctacccagtacaaaaggctgcctttaaaggcccctactggcttggtagctgccgggatgaattgtcttgtcctgctgccctttgctgcgtgggcagcactctgaagcaggcaaatgggtcttgggatccctcccagaaacctgctctgaccagaccctcaggcagcctggggatggcaccaagctctactgccccactatctctggcctggcaaaggctgaaggtgagcagaaggagcaagaggacagaagcaaaactatatgaacctggggggggttacctgggacctgaccccaccctcctgggaaggcatgcttcagcctggggcagaggtaggatggctgactggttttggctggcctctgctgccctcatcctgggctagtcagatgggagccaaagttgatatacaaataaagttgttttgggcctcttt

SEQ ID NO: 315 - DNA, 654 bp, Rattus rattus
ccgctgccgccatgaaccccgaatatgactacctgtttaagctgcttttgattggtgactcgggcgtgggcaagtcatgcctgcttctgcggtttgctgatgacacgtacacagagagctacatcagcaccattggggtggacttcaagattcgaaccattgaactggatggcaaaaccatcaaactacagatttgggacacagctggtcaggaacggttcaggacagtcacttccagctactatcggggtgctcatggcatcattgtggtgtatgacgtcactgaccaggaatcctacgctaatgtgaaacagtggctgcaggaaatagatcgctacgccagtgagaatgtcaataaactgctggtaggcaacaagagtgacctcaccaccaagaaggtcgtggacaataccacagccaaggaatttgcagactctctgggtgtccccttcctggagacaagtgccaagaatgccaccaatgttgaacaggcattcatgacaatggctgcagagatcaaaaaacggatggggccaggagcagcatctgggggtgaacggcccaacctgaagatcgacagcactcctgtgaaatctgctagtggtggctgctgctaggggggggtacttggggagggcacttctccagatgatg

SEQ ID NO: 316 - DNA, 574 bp, Rattus rattus
gacagttcgtgagagagaagctttattaaaactagtggcagatctggactgctactgttgcgcctttggtgcatgttgagcctgggcaaggatgggtacatagggagatacaggtgggatgaggagcaaagagggagggcgctgcctactgagactgtgctcaactgttctcccagaagaagttgttacaagccactgtgagagcagccaccagcacaacaaactcctggaagtccacttccccatctccattctcatccagttccttcatgatcttgtccacagcatctgcatccttctggacatccaggaagctggagagttcagtttgtagcaggtctttcagctccttcttgctcagcttatatttgtccccttccttgcccgagtgggcatggaacacattgatgagggtctccatggcggtctccagctcagagcccatttcagcagcacacggttggcctcggcctgacgtcggagcaggttcttgacagaagggcgcgctgcaaatgttgccccggagcagtgtggggagacctgtctttactgccgaccctcctccccttgtgcc

SEQ ID NO: 317 - DNA, 1064 bp, Rattus norvegicus
aagcttttaatttacccaataatcttgaatgaaaaatttaaaactagcaacgtttgagaagcaatttccaaagttaaaagcaatggtacacattgcagattctgtgaagaaatgagggtaaatttttaaaggaattatcttctatatgttttatagattctctatctcaaacgagactcaagatgtcagtcagcctcagcatttctctcatttccttttgctgtaattaatcaaatccttcctttctggccactatgtcttcctgaaaatgaataagaaataaaataccatttgatgtttaaaattattggggctatcttaatgacggaaatagatgattgggaggggaagaggatgcctgattatatatatattcatgaaggtgtcgaaggtttataaagtcaatgtctgcagatgagaaagcagtggttctcttaggacttcttggggaagtgtggtcccagtggtcatcaccatgaacagccaggtgtcagcccggaaaggtatgtgctgcagctcattgaataagtggctttctcagtattcctgatgaccgatggggttgtatacctaatgcaggtttcaattttagagggggatgaggaataactgtttttctccagacatggcatgaccaaaactactgacacagaccccaagacagctgtggttttgtccaaatttgttccttattcatgtcagcacagatattaaaatgatatttgggtttagagcaagggtgatggggttgatgctattccacagaagaggatgggaacatcatgagacacttaacttgcactccagctaagattcaccacccatgttgagttaatcacagagatgcagctgtctgtgagttaacagtggagtttagagtcatagcctattttttgactttgaaatttttcatgtgcaaatataacagactattagttagattagtgccttcctagtcagagggagacatccttcttttagagatgtgaaatagctagaggtaaatattgatgacataatggaagtacgaaaggaaaaaggagacttgaactgttgctaatggg

SEQ ID NO: 318 - DNA, 814 bp, Rattus norvegicus
gaattccctggcctggctggcaccatgtgtgcatcccgcgatgattggcgctgtgcgcgctccatgcacgaattcgcagccaaggacatcgatgggcacatggtttgcctggataagtacaggggttgcgtgtgcatcgtcaccaacgtggcctcgcaatgaggcaaaaccgacgtaaactacactcagctagtcgatctgcatgcccgatacgccgagtgtggtttacgaatcctggccttcccttgcaaccagttcgggaggcaggagccaggaagtaatcaagaaatcaaggagtttgcagccggctacaatgtcaggtttgacatgtacagcaagatctgtgtaaatggggacgatgcccacccactgtggaaatggatgaaagtccagcccaagggcaggggcatgctgggaaatgccatcaaatggaactttaccaagtttctcattgataagaacggctgcgtggtgaagcgctatggtcccatggaggagccccaggtgatagagaaggacctgccgtgctatctctagccctacaagtgtgtgcccctgcaccgagcccccctgccctgtgacccctggagccttccaccccggcactcatgacggtctgcctgaaaaccagcccgctggtggggcagtcccgaggacctggcgtgcatccccgccggaggaaggtccagaggcctgtggccccgggctcgagcttcaccttggctgccttgtgggaataaaatgtagaaatgtgcaaaaaaaaaaaaaaaaaaaaaaaaaaaaaaaaaaaaaaaaaaaaaaaaaaaaggaattc

SEQ ID NO: 319 - DNA, 665 bp, Rattus norvegicus
atggctgccatgtcagaagaaggctcttgtgtcaacttcaaagaaatgatgtttattgacaacacactttaccttatacctgaagataatggagacttggaatcagaccactttggcagacttcactgtacaaccgcagtaatacggagcataaatgaccaagttctcttcgttgacaaaagaaacccgcctgtgttcgaggacatgcctgatatcgaccgaacagccaacgaatcccagaccagactgataatatatatgtacaaagatagtgaagtaagaggactggctgtgaccctatctgtgaaggatggaaggatgtctaccctctcctgtaaaaacaaaatcatttcctttgagaaacgtgtgccaggacacaacaaaatggaatttgaatcttccctgtatgaaggacactttctagcttgccaaaaggaagatgatgctttcaaactcgttttgaaaaggaaggatgaaaatggggataaatctgtaatgttcactcttactaacttacatcaaagttaggtattaaggtttctgtattccagaaagacgattagtatacacgagccttatgataacctactctgtatttctatgacaaaatacctgaggccgcatgatttatagagtaaacaagcttgattgcccaaaaaaaaaaa

SEQ ID NO: 320 - DNA, 433 bp, Rattus rattus
aagtgggttattcagagaaatataaggcatggatttaaaatggagagaggagcctgttgactacaaactgggaaagggtgcattttactgatcacactcagcaatgttggccagggaccggttcccttgaagccctgcgcacctgaacaaccgatgctttctagcagaaaccctgatcccccaggtactaggcaagtcacctgcaaatccagccaggagaaaatgacgctcccctggtagtcagagtcccaaataccagatacagggcagggaggctcatgagctgaggtcagcctgggctccaaggtgaggccttgtctccaaaattagaaaggaaaaaaacagataaaataaaaacaagagtaactgtctcactgagcccaagcaagcatccctcaccatctcggctacaaagacctgggggggggggggg

SEQ ID NO: 321 - DNA, 1227 bp, Rattus norvegicus
ggaattcgcaacgcctacacaaagatccctatcactgagcacccggaggcaaggctcagaaccccaggatcagcaacatggagttctcccgtccaccgctagtgcatgtgaagggtatcccactcatcaaatactttgcagagacaattgggccattgcagaacttcacagcctggcctgatgacttgctgatcagcacatacccaaagtctggtactacctggatgagtgagatcctggatatgatctatcagggtggcaagctagagaagtgtggccgcgcccccatctatgcccgggtacccttccttgagttcaaatgtccaggggttccctcaggtcttgaaactttggaagagacaccagccccacggctccttaagacacatctgcccctgtccttgctccctcagagtctgctggatcagaaggtcaaggtgatctacattgcccgaaatgcaaaggatgtggttgtctcctattataacttctacaacatggccaagctgcaccctgatccaggcacctgggacagcttcttggagaacttcatggatggggaagtgtcctatgggtcgtggtaccagcacgtgaaggagtggtgggagctgagacacactcaccctgttctctatctcttctatgaagacataaaggagaaccccaaaagggagatcaagaagattctagagtttttggggcgctctctacccgaggagactgtggattccattgttcaccacacatctttcaagaaaatgaaagagaactgcatgactaactacacaaccatccccactgagattatggaccacaatgtttctcccttcatgaggaaaggtactactggggactggaaaaataccttcactgtagcccagaatgagcgctttgatgcccactatgctaagacaatgacagattgtgacttcaagtttcgttgtgaactatgagtggattatggctatactgggaaccaaggcaaactgacacagcccatcatgatctcaagtaaaatgtgatgtgttcaatctacttgttgtatgcctagaggaaatctgagctaagagaataggattggggatgtggctgaggcagagggttttatcaacgcatgtcaggaaagcaatcagtcccaacacctaaaaagaacctaaagtacaaacatgcaaaaaatagtaagataaactatattttacctgaaagaataaatgccactgggaaatg

SEQ ID NO: 322 - DNA, 6402 bp, Rattus norvegicus
tgtgaggcagcggcgctgcgactctctctcccccggctccttagtgggagcgccggccagggacccgagccgcgctgtacgcagcgtccacccgcccgctccgcaggtccccgagcgtcgggcggcgatggagcccgggcccgcggcgccctcgtctggcgccccgcggcccgcccgggatggggacgcgccgctgactgccgccggggtggacctgcccggcacggccgtactctccggtcgagaggatgctaccgctgggagccaggccggcggcggggtgcgcggagagggaaccccggccgctggcgatgggctgggcaaacctctggggcccacccccagccagagccgcttccaggtggacccggtttccgagaacgccgggcgggccgcggctgctgcagctgcagcggcggctgcggcggctgccggggcagcgggcaaggagacccccgcggctgggaaagccggcactgagagcggcgtggccaagggcagcgaggaagccaagggccgcttccgcgtgaacttcgtggacccggctgcctcctcgtcggcggacgacagcctgtcggatgcggcgggagtcggtggcgacgggcccaacgtgagctcccagaacggcggggacacggtgctgagcgagggcagcagcctgcactcgggtggtggcagtggacaccaccagcagtactactatgacacccacaccaacacttactacctgcgcaccttcggccacaacaccatggacgcggtgcccaggatcgaccactaccggcacacggccgcgcagctgggcgagaagctgctccggcccagcctgggagagttccacgatgagctggaaaaggaaccttttgaggatggttttgcgaatggagaagaaagtactccaaccagagatgctgtggtcacatacactgccgaaagtaaaggagttgtaaagtttggctggatcaagggtgttttagtacgatgtatgttgaatatttggggtgtgatgctctttattcgattgtcatggattgtgggtcaggctggaataggtctctccgttcttgtaatagcaatggccactgttgtgacaaccatcacaggattgtctacttcagcaatagctaccaatggattcgtgagaggaggaggagcatactatttaatctctagaagtctagggccagaatttggcggtgcgattggcttgatcttcgcttttcccaatgcagtggcagttgctatgtatgttgttggattcgcagagactgtagtggagctgcttaaggaacattccatacttatgatagatgaaatcaatgacatccgaattattggagccattacagtggtggttcttctgggcatctcagtggccggaatggagtgggaagcaaaggctcagatcgtccttctggtgattcttcttctggccatcgctgacttcgtcataggaacatttatctcactggacagcaagaagcccaagggtttctttggctataaatctgaaatatttagtgagaactttggaccggattttcgagaagaagagactttcttttctgtattcgccatcttttttcctgctgcaactggtattctagctggggcgaacatctcgggtgaccttgcagatcctcagtcagccatacccaaaggaacgctcttagccattttgattacgacagtggtttacataggaatcgcagtgtctgtaggttcttgtgttgtccgggatgccactgggaacgttaatgacaccattacaacagagctaactaactgtacttctgcagcctgcaaattaaactttgacttttcctactgtgaaagcaacacctgttcttatgggctaatgaacaactttcaggtgatgagcatggtgtcaggatttgcacccctgatctctgcgggtatcttttcagccacactctcatcagcactggcatctcttgtgagtgctcccaaaatatttcaggctctatgtaaggacaatatctacccagctttccagatgtttgcgaaaggttatggaaaaaataatgaacctcttcgtggttacatcttaacattcttaattgcacttggattcatcttaattgctgaattgaatgtcattgctccaattatctctaatttctttctcgcatcatacgccttaatcaacttttctgtattccatgcgtcacttgcaaagtctccagggtggcgtcctgcgttcaagtactacaacatgtggatctcccttactggagcgattctctgctgcatagtgatgttcgtcattaactggtgggctgcactgctcacatatgtgatagttcttggactgtacatttatgtcacttacaaaaagccagatgtgaactggggatcctccacacaagcgctgacttacctcagcgcactgcagcattcaatccgtctttccggggtggaggaccatgtgaaaaacttcaggccacagtgtcttgtaatgacaggttctccaaactcacggcctgctttactgcatcttgttcatgacttcacgaaaaatgttggtttaatgatctgtggccatgtgcatatgggtccccgaagacaagctatgaaagagatgtccattgatcaagccaaatatcagcgatggctcattaaaaacaaaatgaaggctttctacgctccggttcacgcagatgacttgcgggaaggtgcacagtacctgatgcaggctgctggacttggtcgtatgaaaccaaacacacttgtcctcggatttaagaaagattggttacaagcagatatgagggatgtggatatgtatataaacttatttcatgatgcttttgacatacagtatggagttgtggtcattcgcctaaaggaaggactggatatatcacacctccaaggacaagaagaattattgtcatcacaagaaaagtcacctggtaccaaggatgtggtagtaaatgtggactacagtaagaagtcagatcaagatgctttcaaagcatctggtgaaaaacctattacacagaaagatgaggaagaggatggcaagacttcaactcagccactgttgaaaaaagaatccaagggccccgtggcacctttaaatgtagctgaccaaaagcttcttgaagctagcacacagtttcagaaaaaacaagggaagaatactatagatgtctggtggctttttgatgatggaggtttgaccttgttgataccctatcttctgacaaccaagaaaaagtggaaagattgtaagatccgagtattcattggtggaaagataaacagaatagaccatgaccggagagcgatggctactttactcagtaaattccgaatagacttctccgatatcatggtcctaggagacatcaacaccaaaccaaaaaaggaaaacatcgtcgcttttgatgacatgattgagccatacagacttcacgaggatgataaagagcaggatattgcagacaaaatgaaagaggatgagccctggcgcatcacagacaacgagctggagctctacaagaccaagacatatcggcagatcaggttaaatgaattattaaaggagcattcaagcacagctaatattattgtcatgagtcttccagttgcccggaagggtgctgtgtccagcgcgctgtacatggcttggttagaagctctgtctaaggacctgccaccaatcctgctggttcgtgggaatcatcagagcgtccttaccttctactcttaattgtcctgccccatggactccctctaagaatggtacttcagtgcctagtcagagtgactggatcgtcagcaacaccgcagcatcacagtggcgaactgggtctttgtttcactacttcattctttgaaagcacatggacacgttgctccactgatagatctgtggagacttcggttttagtctactccagatctcagtcttatgactgctgattcttccttgttggactgaagttcttgagagtaaagttttcctttgctacttgacagcaataagagtgagttatttttgattgctgaaaggagtacataagcctttagccttgaggtgccttctgaaattaaccaaatttcatccatagatctatcgtcttttgtacatttatagaatgttaaactctgccttcagacattatttttacttctaatctctgtcatcctaagtggacactgcttgtctcctcccattgaccagttagtgttgagagctgtgtgtttcgtattacttttgtaaaagcgtttgttggatactgaagagggtaggacaagctaataaaatatgtggagaaagtatccaaaaatggagcccaaggttaggtttatatgaatagatacttagagctagggaagagaggcccgaacaccgtttctatctctcaattagagttatctattatttcttttaaatcatagagatgactgacgatctacccagtacttcatttataacataaaaaaaaaaaatcacatttttttaaagcaaaaccttgaggtcatttgtattgtttttaaaagatctcttttaatttagaatttcctctcaaatgggagggacttttaagacatgctaactggtatttttcgaggaaatttagacaaagcattgccatttactagagcatttcaataaaaactatggggatttcactatcctatcgcatcctttatttaaaaagaaagatgacaatgttatcaatggttaaatggaccactgttttcttagtgaaatggttttaggcttaatttattcaagtatcaagaacatttagtcttaatacactcaggtttgaacagattattccgaacattgaaatttaatccattcttaatactttaaaacttgcgttaaagaaaactgccagtttgtgcatttgaccttgtcgtctgcaagtgcacttgacagtgagcgtgcacacctgcgctgtcctgaacgctttatacacagtcgttaatgtgaagtgtctaagttcaaggaaggatcttctaaacatttcaagggattcatgtccacatgtctgtctgtgtgtatgttttgcatacacaggtgcatatgtgtatatgtaatgaaatttatgttgccagtgtttcagattttaaagcgatcatgatttggtaggttacagattttgttgttgttgttgttttagttttttcttttcttttttaagtaagcattcaagtcagatcaagacattacagatttcatggaggacaaagacaattgaaagaacatcgtgtagctttgtacagttatccagttatgtaaagtagatgatctgtaagtttcagtggagaacatagcgcagactttcatcatcttaagggaaatgtcagaaaagcatttcagtagtgtagtacttgtgctccatgaaaacagactgcgttaataccagctggatatcttctcgtttccactcagaatattaaagaaaacaaggttaagtgattttttccaagttcttcttacattataatataatattgttccatttattgtaaattttgcagagtttagggcagtatagaagaatcatattagcaaaccatatcatgtgtggatcttctgaatggatactagggcatgggctgaatgctgctatcttgaaatgtacacagctagacttgccttttatttttaaaggttttccctcattcaggaaacttcattgtgatctgtactacagaaactaaatgtcatacatcatacgtgtgtgttcaaagtacataaaatggatctcaacgcacctaacagggagggtggcgacactgtgaagtgatgccagcagcagctctctactcttgaaaaccgccttccgtcgtcagctaacacgagctgccaggccagacgttctcaaggttgcagtagtactctaaaacgaaacttctcaatggttaattcttagacatctagctagtattagagctgttttcattttacgctgtttggattatttggatgccaaattatgttttagtcctaatcattgataataacttaaaaatacgcagtggcatttgagctcattcttgggataagttaaaaacttgagtgcgttcaaagagaacgtcgttgatgattaacggttcactaaatcagatattcatttgtctcatcttttccttcctgctttgttttccttcactcttctcatatggctctcctgacgtgtgtgtggtttgttttgttttgtttttttaagactatggaaataatttaatgagttgagctccggtgatgatctgctaagtttgaaaatgtaatattttgataatactgtactgtacctgtcccaaatgcttttgtaatgttttaaccccgagtattgcagttgctgctccgtacagaggttactgcaataaaggaagtggaatcattaaaacttt

SEQ ID NO: 323 - DNA, 4673 bp, Rattus norvegicus
caatcgggcaggggcaagagcagagccgaggctgggtttgaccagagcgcggggagttggaaaggagacagagctccgagagcaaaaaaccagctatagcagttggtgagctggtccctgctgggtacctgctgcttccaccgacccccaccctcattggggatttccccagacgctgcccccaacgtcttggttcccctcagctctgcgtgctccaaaagaagggtggtaggaaaaggccacgggagagcctgcgctccggtgccctgggccctggaagcaccagttggcagctgtggtctcttggggcttcaaccaggacccccgacggctgagaggagaagcccaagcctttggctgcggaaggctttttgtgcttggcctaggaagaacgggcaggaacaaaggcacgataaggacagcttaccattcgaatagcagggggaggttctctcttctctgtcctctggctgtgtggtctctggcccttcccttcttctgtttgtccatctacctctctctatgcctgctctggtttctctgcaggaccctccagtggacatgggtggggccctagggcccgccctgctgcttacttcactccttggtgcttgggcaaggctgggcgcagggcagggagaacaggccgtgactgtggcggtggtgtttggcagctctgggccactgcagacccaggcccggactcgtcttacctcccagaacttcctggacctgcctctggagatccagccactcaccgtaggggtcaacaataccaatcccagcagcatcctcacccaaatctgcgggcttctgggtgccgcccgtgtccacggcatcgtctttgaggacaacgtggacaccgaggccgtggcccagctactggacttcgtctcctcccagacccacgtgcccatcctcagcatcagcggaggctctgctgtggtcctcacccccaaggagccaggctccgccttcctacagctgggcgtgtccctggagcagcagctgcaggtgctgttcaaggtgctggaggaatacgactggagcgcgttcgcggtcatcaccagcctgcatccgggccacgcgctcttcctcgaaggcgtgcgcgccgtcgcggacgccagctacctgagctggcggctgctggacgtgctcacgctggagctaggtccgggtgggccgcgagcgcgcactcagcgcctgctacgccaggtcgacgcgccggtgctggtggcttactgctcccgtgaagaggccgaggtgctcttcgctgaggctgcacaggctggcctggtgggacccgggcacgtgtggttggtacctaacctggcgctgggaagcaccgacgcaccccctgcagctttcccggtgggcctcatcagtgtggtcaccgagagttggcgccttagtctacgccagaaggttcgcgacggagtggccattctggccctcggtgcccacagctaccgacgccagtacggtaccctgccagccccggctggggactgccgaagacacccgggacccgtcagccctgctagggaggccttctacaggcatctgctgaatgtcacctgggagggccgagacttctctttcagccctggtgggtacctggttcggcccaccatggttgtgatcgccctcaaccggcaccgcctctgggagatggtgggacggtgggaccatggagtcctgtacatgaagtatccagtatggcctcgctacagcacttctctgcagcctgtggtggacagccggcacctgacagtggccacactggaagaaaggccctttgtcattgtggagagccctgaccctggcacaggtggctgtgttcccaacaccgtgccctgccgcagacagagcaaccacaccttcagcagcggggatctaaccccctacaccaagctctgttgtaagggcttctgcatcgacatcctcaaaaagctggccaaggtggtcaagttctcctacgacttgtacctggtgaccaacggcaaacacggcaagagggttcgtggtgtgtggaacggcatgatcggggaggtatactacaagcgggcagacatggccatcggctccctcaccatcaatgaggagcgctctgagattatagatttctctgtgccttttgtggagaccggcatcagtgttatggtatcaaggagcaacggcaccgtctccccctcagcttttctggaaccctacagccctgccgtgtgggtgatgatgttcgtgatgtgtctcacggtggttgccatcactgtcttcatgttcgagtacttcagccctgtcagctacaaccagaacctcaccaagggcaagaaacctggtggaccatctttcaccattggcaagtccgtgtggttgctgtgggcactggtcttcatcaactctgttcccatcgagaacccccggggtaccaccagcaagatcatggtcctggtgtgggccttcttcgctgtcatcttcctcgctagctatacggccaatctggcggccttcatgatccaggagcaatacatcgacactgtgtcaggccttagtgacaagaagtttcagcggcctcaagaccaatacccacccttccgttttggcacggtacctaacggcagcacagagaggaacatccgtagcaactaccgtgacatgcacacccacatggtcaagttcaaccagcgctcggtggaggacgctctcacaagcctgaagatggggaagctggatgccttcatctatgatgctgctgtgctcaactacatggcgggcaaggacgaaggctgcaagctggtcaccattgggtctggcaaagtctttgccaccactggctatggcattgccatgcagaaagactcccactggaagcgggccatagacctggcactcctgcaacttctgggggatggagagacgcagaagctggagacagtgtggctctcagggatctgccagaacgagaagaatgaggtgatgagcagcaagctggacattgacaacatggcgggggtcttctacatgctgttggtggccatgggactggcccttctggtctttgcctgggagcacctggtctactggaaacttcgacactcggtgcccaactcatcccagctggacttcctgctggctttcagcaggggcatctacagctgcttcaacggggtacagagccttccgagtcccgcacggccgcccagcccggatctcaccgcagactcagcccaggccaatgtgctgaagatgctgcaggcggcccgagacatggtgaacaccgcggacgtgagcagctctttggaccgcgccactcgcaccatcgagaactggggcaacaaccgccgcgtgcctgctcccaccgcctctggcccgcggtcctccaccccgggtcctccgggacaaccgagccccagcggctgggggcctcctggtgggggccgcaccccgctagcgcgcagggccccgcagcctccggctcgccccgcgacgtgcgggccacctttgcccgatgtgtcccgaccatcctgcaggcacgcttcggacgcgcggtggccggtgcgagttgggcatcagggaccgcacgtctcggcttccgagcggcgcgcgctcccggagcgctctctgttgcccgcgcactgccactacagttccttccctcgagcggagagatccgggcgcccctacctcccgttattcccggagcccccggagcccgacgacctggctctgctcgggccggaacagctggctcggcgggaagcaatgctgcgcgcggcctgggcgcggggcccgcgccctcgccacgcttccttgcccagctcggtggcagaagctttcactcgatccaaccctctgcctgccaggtgtaccggtcacgcctgtgcctgcccgtgcccccaaagccggccatcctgcaggcacttggctcaggcacagtcgctgaggctgccgtcctacccggaggcctgtgtggagggcgtaccagcaggggtggccacctggcagcccagacagcacgtctgcctgcacgcccatacccgcctgccgttctgttggggaactgtctgccgtcaccctccaccctgtaccagccacagcccctggctcattggaacctgggagcctccagcacacagagtcaggaccctggggctaggcacaggctacagggacagtggggtgctggaagaggtcagcagggaaacctgtgggacacaaggttttccaaggtcctgcacctggaggcgggtctccagcctggaatcagaagtgtgaggttactggcagctttggttcctgctggactggcttctgtggccggccttggccaggtttgggggacaggccagcttgggctcctctggcttctattttgaaatcctggccatgggaccccagtgaaaaggatatcttccaggcccagcttttgaccttagtgtgggctgggatcttgttcatcacatgacctcttgcggtggtcacagggagtaaaaatgtgtccctgtcctgttgtcagctagttcctagttgtggttgctgtggccttgggttgggacacagaaattggaaatcgaggttggggtggggccatcccacttctttgccgcaataggctggggtttcttttcataggggcattggaacattaaagcaacgttttacagcgcaaaaaa

SEQ ID NO: 324 - DNA, 2866 bp, Rattus norvegicus
gtggaggaaagttgcgtgtggcacagacccgacggcgcagcgccacagcgaccgggggatcgtgtgtcttggaaaaaaaagtcgctgtccccctaagcgagacccacaagcgagcgggccccgtgggcccggggacgacgccccctctgcggcgtggactttgtcggtggccttctaggaggaggaatatggcatctaaagggtccccttcttgccgtctggttttctgcctcttgatctccgccgcggtcctcagaccaggcctcggatggtacactgtcaactcagcatacggagataccattgtcatgccttgcagactggatgtacctcagaacctcatgtttggcaaatggaaatatgaaaagcctgatgggtccccagtatttattgcattcagatcttctacaaagaaaagtgtgcagtatgatgatgtaccagagtacaaggacagactgagcctctcagaaaactacactctgtctatcaacaatgcaaagatcagtgacgaaaagagatttgtgtgcatgctagtgaccgaggacaacgtgtttgaggcacctaccctggtcaaggtgttcaagcaaccatctaaacctgaaattgtaaacagagcagcgtttcttgaaacagagcagctaaaaaagttaggtgactgcatttcaagagacagttacccagacggcaacatcacgtggtataggaatgggaaagtgctacagcctgttgatggagaggtgtccatactttttaaaaaggaaattgatccaggtactcagttgtataccatgacttcctccttggagtacaagacaaccaagtctgacatacaaatgccattcacctgttctgtgacatattatggaccttcgggccagaaaacaatttattctgaacaagcaatctttgatatttactatcctacagagcaggtgacaatacaagtactgccaccaaaaaatgccatcaaagaaggggacaacatcacccttcagtgcttggggaatggcaacccacctcctgaggagttcatgttttacttaccagggcaggctgaaggcataagaagctcaaacacttacacactgacagacgtgagacgcaatgccaccggggactacaaatgttctctcatcgaccaaagaaacatggcagcttcaacaaccatcactgttcactacttggatttatccttaaacccaagtggggaagtgaccaagcagatcggtgataccctgcctgtgtcttgcacaatatctgcaagtaggaatgcaactgtggtgtggatgaaggataacatcaggctccgatctagtccatccttttctagtcttcattatcaggatgctgggaactatgtctgtgaaactgctcttcaggaggttgagggactgaagaaaagggagtcgctgaccctcatcgtagaaggaaaacctcaaatcaaaatgacaaagaaaactgatcccagtggactgtctaagactataatctgccatgtggaagggtttccaaagccagctatacagtggaccattaccggcagtggaagcgtcataaaccaaacagaggagtctccttatattaatggcaggtattatagtaaaattatcatttcccctgaggagaatgttacattaacttgcacagcagaaaaccaactggagagaacagtaaactccctgaatgtctctgcgataagtattccagaacacgatgaggcagacgatataagtgatgaaaacagagaaaaggtgaatgaccaggccaaactaattgtgggcattgtggttggtctcctcctcgccgccctcgtcgccggtgtcgtctactggctgtacatgaagaaatcgaaaactgcatcaaaacatgtaaacaaggaccttggtaatatggaggagaataaaaagctagaagaaaacaatcacaaaacagaagcctaagagaggagttgtttagatgtcctgagaaaaaaacatataaagaaattgaagcatgaacgtgattgtatttaagacatatacaaagacaatgacagcaattcatggttcaagtattaagatgttcatcctactaagctgtcctgggatcttagagaattatctcaagtaaaacaatgaaataaagttataaaattacaacaagatttggcagccatgataataggtcatatgttgtatttcgtttgattttccttttctgtaaatgtctgcactgaggatttctttcagtttgccttttatgtaaattttttacgtagctatttttatacactgtaagctttgttctgggagtggctgttaattggatgtacaatgtaatgtttatttcaattgtttatatggatagtctgagcaggtgcggttctgattctgattgctatcagtaatgccccaaactttcttgtgaggatctgaaacccaaaggtggcagttatgagattgggacatggatcttgcccaatcagaagctggttttttttttaaaaaaaaaaacctggagagtcaggagcaccataagatatgatggtctctatgtgccaacgggttccccgaagcgggtcacaaacacatacggcaacaccacatgtgaatgatacttttaaactgacaatttcgtcttctctgaaaaaagacatacacagagtttgtataacactttacttaacgacacttgctagaaaattacattctgtttttaaaaaaaataaggaaaatgtaaagaagaatatctaatatgtcagagaaagttggaaacaaatcacagctcgcatccccatagtcgcagatcacgatgtaaatcactgtaattaaaattggtgttaaatcctttgggttatccactgccttaaaatgacacttatttcctt

SEQ ID NO: 325 - DNA, 3471 bp, Rattus norvegicus
ggcacgaggaccggctgaggattttatggttcttaagcggacttaagagcgttgtttcggattgttaagattcccgtttgctgggttttcctccctcaatcgtgctctcccgcggctgcctggggactggctcggcgaaggaggatggagagggggctgccgttgctgtgcgccacgctcgcccttgccctcgccctggcgggcgctttccgcagcgataaatgtggcgggactataaaaattgaaaacccggggtaccttacatctcccggctaccctcattcttaccatccaagtgagaaatgtgaatggctaatccaagctccggagccctaccagagaatcatgatcaacttcaacccacatttcgatttggaggacagagactgcaagtatgactatgtggaagtgatcgatggagagaatgaaggtggccgcctgtgggggaagttctgtgggaagatcgcaccttcacctgtggtgtcttcagggccatttctcttcatcaaatttgtctctgactatgagacccacggggcaggattttccatccgctatgaaatcttcaagagagggcccgaatgttctcagaactatacagcacctactggagtgataaagtcccctgggttccctgaaaaataccccaacagcttggagtgcacctacatcatctttgcaccaaagatgtctgagataatcctagagtttgaaagttttgacctggagcaagactcaaatcctcccggaggagtgttctgtcgctatgaccggctggagatctgggatggattccctgaagttggccctcacattgggcgttactgtgggcagaaaactcctggccggatccgctcctcttcaggcattctatccatggtcttctacactgacagcgcaatagcaaaggaaggtttctcagccaactacagcgtgctgcagagcagcatctctgaagatttcaagtgtatggaggctctgggcatggaatctggagagatccattctgaccagatcactgcatcttcccagtatggtaccaactggtctgttgagcgctcccgcctgaactaccctgaaaacgggtggacaccaggagaggactcctacagggagtggatccaggtggacttgggcctcctgcgattcgttactgctgtggggacacagggtgccatttccaaggaaaccaagaagaaatattatgtcaagacttacagagtagacatcagctccaacggagaggactggatcaccctgaaggagggaaataaagccattatctttcagggaaacaccaatcccacggatgttgtctttggagttttccccaaaccactgataactcgatttgtccgaatcaaacctgcatcctgggaaactggaatatctatgagatttgaagtttatggctgcaagataacagattacccttgctctggaatgttgggcatggtgtctggacttatttcagactcccagattacagcatccaaccaaggagacaggaactggatgccagaaaacatccgcctggtgaccagtcgaaccggctgggccctgccaccctcaccccacccatacatcaatgaatggctccaagtggacctgggagatgagaagatagtaagaggtgtcatcattcaaggtgggaagcaccgagaaaacaaagtgttcatgaggaagttcaagatcgcctacagtaacaatggttctgactggaaaatgatcatggatgacagcaagcgcaaggctaagtcttttgaaggcaacaacaactatgacacacctgagctccgggcctttacacctctctccacaagattcatcaggatctaccccgagagagccacacatagtgggctcggactgaggatggagctactgggctgtgaagtagaagtgcctacagctggacccacgacacccaatgggaaccccgtggacgagtgtgacgatgaccaggccaactgccacagtggcacaggtgatgacttccagctcacaggaggcaccactgtcctggccacagagaagccaaccattatagacagcaccatccaatcagagttcccgacatacggttttaactgcgagtttggctggggctctcacaagacattctgccactgggaacatgacagccacgcgcagctcaggtggagggtgctgaccagcaagacggggcccattcaggaccacacaggagatggcaacttcatctattcccaagctgatgaaaatcagaaaggcaaagtagcccgcctggtgagccctgtggtctattcccagagttctgcccactgcatgaccttctggtatcacatgtccggctctcatgtgggtacactgagggtcaaactgcactaccagaagccagaggaatatgatcaactggtctggatggtggtcgggcaccaaggagaccactggaaggaagggcgtgtcttgctgcacaaatctctgaaactgtatcaggttatttttgaaggtgaaatcggaaaaggaaacctcggtgggattgctgtggatgatatcagtattaacaaccacattcctcaggaggactgtgcaaaaccaacagacctagataaaaagaacacagaaattaaaatagatgaaacagggagcaccccaggatatgaagaagggaaaggcgacaagaacatctccaggaagccaggcaatgtgcttaagaccctggaccccatcctgatcaccatcatagccatgagtgccctgggggtgctcctgggtgcagtctgtggagttgtgctgtactgtgcctgttggcacaatgggatgtcggaaaggaacctatctgccctggagaactataactttgaacttgtggatggtgtaaagttgaaaaaagataaactgaacccacagagtaattactcagaggcgtgaaggcacggagctggagggaacaagggaggagcgcggcaggagaacagtggaggcgcagggactctgttactctgctttcactgtaagctgggaagggcggggactctgttactccgctttcactgtaagctcggaagggcatccgcgatgccatgccaggcttttctcaggagcttcaatgagcatcacctacagacacaagcaggtgactgcggtaacaacaggaatcatgtacagcctgctttcttctcttggtttcgtttgggtaatcagaagccagttgagaccaagtgtgactgacttcatggttcatcctacttggccccctttttcctctctttctccttaccctgtggtggattcttctcggaaactgcaaaatccaagatgctggcactaggcgttgttcagtgggctctttcgatggacatgtgacctatagcccagtgcctagagcatattagcataaccacatttcaggggacaccaatgtccgcttttgcatcgctacgtgcagcgagcacaggaaaaagaaaaaaaaaaaaaaaaaaactcgag

SEQ ID NO: 326 - DNA, 466 bp, Rattus norvegicus
aggaaagacagaatcctactagaggccagaaagaatgttccagacatgggtggaaggccctcactcccgactgacttcaatacgcctgaaggtagggagtgctccatgtctgcccccaggctccaagggtgggtctcctagggcctggaaaatgccccaccaatctggctaagataaggaaagggtatgaagagaaagttacagaaatttgaagggttaagctaagttgctgagagttagtataagttacagagaaagtaaggttaaacaaagagaaagagaaaagaaggtaaaaagagcaggaagctagggaagaaaagagactaaaagaagaggaagctagagagctaaagagagataaaagacaagagaggaacatatactggccacagtagttagggaacctaggaagacagtacctggcaacagaagagaattcctggctaaagatcagtgtgcctaatgc

SEQ ID NO: 327 - DNA, 3312 bp, Rattus norvegicus
atggacattcggaaattctttggggttatatcaagtggaaaaaagcctgtaaatgagacagtaaagaagaatgagaagacaaaaccttcggagggaactgtcaaaggaaagaaaggagtaaaggttgccaaggttaataatccctgcaaagaggatgcctccagaccaaagcagcacacagaaaaacgaggatcatctatgactcagattcagaatcagaggagacacgtgcaagtgaaagatgctaaaaagaaatcagaaaaattgccacgtgtgcttgtaaacctggtaaatctctcggaaggatcctcgttacctcatatttctgagacagatgaagacgcagtgactttttatgtaaaaaggcagcctccaaatcaaaagagaatggagtatctacgaaacagttaccttggagcatcaaacgtgaaaaagaatgaagaaaacactaagactaagagtaaaccgttatcaccaataaaactaacaccgacatcagtgcttgattattttggaactgaaagtgtccagagatctgggaagaagatggtggcgagcaaaaagaaagagtcttctcaaaccccagatgattccagattaaatgatgaggccatcgccaagcagctgcagcttgatgaagatgcagagctggagaggcagttgcatgaagatgaagaatttgcaagaacactggccttgttggatgaagaacctaagaccaaaaaggctcgaaaggactctgaagagggagaatcattttcacctgccaaagctgagttaagcaaagcagcaaagcagaagagccctgctaacgagcatttctcaattggaagaaagacctacagtcctgctaagtacggcaagggtagaggctcagaaggcaccaagcagccctgcagatcagctcaccagacggaagcctgctcctctctcaaggccagctccaagctggctcttatgaaagcacaagaagaaaactctcacacagacacagaactgctggctgcaaaaagagaaagtgccattgagcccaaaggagagaaaacaactcctaggaaaacgaaaggctctccaactaaaagagagtctgtaagcccagaagattctgaaaagaagcgcaccaattatcaagcttatcgaagctacttaaatcgagaaggtcccaaagccctgggctccaaagaaatacccaagggagctgaaaactgcttggagggcctgacgttcgtgatcaccggagtgctggagtccatcgaacgagaagaagccaagtctctaattgaacgttatggggggaaagtaacaggaaacgtgagcaagaaaaccagctacctcgtcatgggccgggacagcaggcagtccaagagtgacaaggcagcagctctgggaacaaaaatccttgatgaagacggcctgttggatctgattcgaactatgccgggcaaaaaatccaagtacgaaatcgctgctgaggctgagatgaagaaagaaaagtccaaattggagagaacaccccaaaaaaatgatcagggaaaaagaaaacttagtccaaccaagagggagttggagcctaaaaagagcaagctgactccccttaagcacagccctcggaaggcagtgaaggaggaggaacgtgtgtgtccgaggggcttggacgccaaggagcctcatggcagccacagtgccagcagagaggagtgcctgctctgggtggataagtacaagcccacctcactcaagaacataatcggacagcagggtgaccagagctgtgccaacaaactgctacgctggctcagaaactggcacaagagttctccagaagagaaaaagcatgcaaaatttggcaaagttgccagcaaagatgatggctccagtttcaaggcagcactgctgtctggccctccaggtgttggcaaaaccactacagcttctcttgtgtgtcaggaattgggctacagttatgtggaactaaatgcgagtgatactcggagtaagaacagtctgaaagcaattgttgctgagtcattgaacaacaccagcatcaaaggcttttatacaagtggagcatctccttctgtaagtgcgaggcatgctctcatcatggatgaagttgatggcatggcgggcaatgaggacaggggtggaattcaggagctaataggcctgataaagcatacgaaaattcccatcatttgtatgtgcaatgatagaaatcaccccaaaatccgctcattggttcattattgttttgatcttcgtttccaaagacctcgagttgaacagattaagagtgcaatgctgtctattgcatttaaagagggattaaagatcccacctccagctatgaatgaaataattttgggagctaatcaagatgtcagacaggttttacacaatctcagtatgtggtgtgcacagagtaaggtcctaacctatgaccaagccaaggctgattctcagagggccaagaaggacatcagattgggcccatttgatgtcacccggaaagtgtttgcagctggagaggagactccacacatgtcactgatggacaaatcggatctctttttccatgactattccattgcacccctctttgtccaggagaactacctccatgtaaagcctgtggctgcagggggtgacatgaaaaagcacttgatgcttttaagccgggcagcagatagcatatgtgacggtgacttagtggccaatcagatccggagtaagcaaaactggagtctctcccacacaggccatttacgccagcgttgttcctggagagttgatgaggggctacatgtctcagtttcccagcttcccaaggctggctgggaaagcactcgtctatgggcaagcactgatcggactgttcaggacctgtccttgcacatgagtcttagaacttactccagcaaaaggacagtgaacatggattacctgtcacacatcagagacgcacttgtacgacccttgacctcacaaggagtagaaggggttcagcgtgttgtcacacttatgttggtgaaagaagattttgacaacatcatggaagttagcagcgatacatactattgggggggcaagcccagtaccttttccaagctggaccccaaggtgaaagcagccttcacaagagcctataataaggaggcccacctgaccccatactcacttcaggtggtaaaggcatcgaggcccagcataggtccagcactggattctgagtacaatgaagagtcacaggaagatgccactcagtctgatgagaaagagcaggatgccctagagactgacgccatgatcaag

SEQ ID NO: 328 - DNA, 525 bp, Rattus rattus
aaagaaaggcatactgcatacacacatcacatgcttgctttctaaacaaaacatgaaaatcattctaatttatagttttcctccatcgtggataaaaattcatctaagtcagtttagcagtcttctcgatcacaaacatgctgtcagacatatacatacttattaataaatgcaatgtgttgtttgttctttaaaggggaagcctgtgtgaattgtgtacttgatttggaagatttgtttttttttttctggcttaggccaaaccacataaaatcttttaagtctagttagtgaaggctacatacacggtctccccagagtccgtttctgaattccactgcaagacggtccccttctcttttccaaaggagaagatgggggctaccaagcaagttcatcctaaagtctcttgggtctagggacaaatactgccattggttagtgttaagtacaggagtgtcttcgtctcctctggcgccccaccttgccctggcaatgcgggtaaggtggggttcacagatccac

SEQ ID NO: 329 - DNA, 1131 bp, Rattus norvegicus
gaattctttacttttctcgctgatcatcattaacatggagagtgcctttggtcctatccccacagcagcccagtttcctgcccctatggttaaaatgactccccaggttgggggacaaaaagagcccctaaaatagtttcaaagaatctacaactgtgaagaactttgttttgccagtcaggattaatgttttcttttccatgggctatagcccactgagacagtttggtaaagggctgttactaaagtcctgaaagccccaggtgaactggttacaattcttttgtcagctgcttagtatttagcacccaggttctaaccatctctccatccttttgttattagttgttactagaagcctagtgtcatttggaggctggttctcttgagagcaaagccaccaagctgacactgaagggaggtaggtactccttaagggaaaatctaagcccagagagacagccggtaacagctaggctgcctctctgctcgcctttctgtttcatagacaaagcttgtgcttatatttacagtggcctttttgtccaaaaaaaggcctcctggtttagctgtgtgactaaatgctatttgtcctcttcagtggacctctctcctctagattcccttcttgttttctcaccatcccacgtgagatgcttgttagtaactgttacaggtcttctttaccaccgaggaaagacagaatcctactagaggcctgaaagaatgttccagacatggctagaaggcccctcacttgtgcctgctctcttcagacgctgaaggtagggagtgccaggtctgcccccaggctccaagggtgggtctcctaggggctggaaaagccccaccaatctggctaagatcaaggaaagggtatgaagagaaagttacagaaatttgaagggttaagctaagttgctgagagttagtataagttacagagaaagtaaggttaaacaaagagaaagagaaaagaaggtaaaaaggcagaagctagggaagaaaagagacaaaaagaagaggaagctagagagctaaagagagataaaagacaagagaggaacatatactggccacagtagttagggaacctaagaagacagttacctggcaacagaagagaattcg

SEQ ID NO: 330 - DNA, 2484 bp, Rattus norvegicus
gaattcagtcacggactttatgcctttgaaagttgtcaccattttattgtcaccctccatcttaaccactgccttgaccttttccccagtcatggtctccagttcgcactcctcccccaaggtgaactcattgtggatcaccttggacccataggtgatggtggctgagggtggctgactgaaaaacggacttccagatttcttactcttccacaagggccctcatcacgtgcgcaggtctctaaccttactctctgaaaggatggcttgccttcttcctgctgctcgacttcctgcaggctttctcttcttagtgctctggggctcagttctaggtgacaagctgctggtggtcccccaggatggcagccactggcttagcatgaaggagatagtggagcacctcagtgaacgcggacacgacattgtggtgctagtgccagaagtcaatttgcttttgggagaatccaaatactacaggaggaaaagcttcccggtcccctacaacctagaagagttgcggacccgctatcgctcctttgggaacaaccactttgctgccagttcccccctgatggctcctctaagagagtacaggaacaacatgattgtcattgacatgtgctttttcagctgccagagcctcctgaaggactcggccaccctcagcttcctcagggagaaccagtttgatgctctgttcacagacccggccatgccctgtggtgtgatcctggctgagtatctcaagctgccttccgtctacctcttcagaggtttcccatgctctctggagcacatgcttggtcaaagcccaagccccgtatcctatgttcccagattctacaccaaattctcagaccacatgacatttccccaacggctggccaacttcattgctaacatcttggagaactacctttatcattgtctgtactcaaagtatgagatccttgcctcagacctcctcaagagagatgtgtccctacctgccttacaccagaactctctgtggctgttacggtatgattttgtgttcgaatacccccggccagtcatgcccaacatgatcttcattggagggaccaactgcaagaagaaggggaacctgtctcaggaatttgaagcctatgtcaacgcctccggagaacatggcatcgtggttttctctttgggatccatggtctcagagattccagagaagaaagcgatggaaattgctgaggctttgggcagaattcctcagacggtcctgtggcgctacaccggaactagaccatcgaaccttgcaaagaacactattcttgtcaaatggctaccccaaaacgatctgcttggtcatccaaaggctcgggcgttcatcacacactccggttcccatggtatttatgaaggaatatgcaatggggttccaatggtgatgatgcccttgtttggtgatcagatggacaacgccaagcgcatggaaactcggggagctggggtgaccctgaatgtcctgaaatgactgccgatgatttggaaaacgcccttaaaactgtcatcaataacaagagttacaaggagaacatcatgcgcctctccagccttcacaaggaccgtcctatcgagcctctggacctggctgtgttctgggtggagtacgtgatgaggcacaagggggcgccacacctgcgccccgccgcccacgacctcacctggtaccagtaccactccttggacgtgattggctttctcctggccatcgtgttgacggtggtcttcattgtctataaaagttgtgcctatggctgccggaaatgctttgggggaaagggtcgagtgaagaaatcacacaaatccaagacccactgagaagtggcaggaagtgaaggagaagtattagtcccttatccaatcagttgaaacttggaaacaagtgttaaatccatgttgcttttattagggaaataattcaccatacactatacacccagaacatttttttttctttttctttttttcggagctggggaccgaacccagaacatcttctttttttaaataaaaacaatctaattgctggccacacccatcagggaagatactggaatatgtgatctgtttctccagtatcttcagtctggacaatgactgccatctgttggtaacttacagaaagtttagtgttctgccttcagtgacagcaccacagtttcccttactcctgtcagctaatggcttcctcccctggattctcagaccagtgtggccttcccagtgttagtcattcctcactgtgctcatgttttgtgggtgcacggcctttgagctttgggagaaaagaagatgaggctgtgacactggtggccctgtgtttgagataataattattgcttgtctctgaatttgatgaaaactgaagtacattctaaagaaagtatgtcttctattgtgttcccaaaccaagaacttgtcaataaattcatataaattgtggaattc

SEQ ID NO: 331 - DNA, 1219 bp, Rattus norvegicus
aattgaggaggtcagaaggtttcgcccggtcgccgagagagacaagcgaacatggcctcgccgaggtggctctggtgtgtgtgtgcgaccgcagcggtcacactgctgctcgtttccaaggttccttcggcctctgcccaaagaaagaaggagaaggttttagtggagaaggtcattcagctgatggaatggaccaatcaaagaccagtcataagaatgaatggagacaagttccgtccccttgttaaagcaccaccaagaaattactctgttattgtcatgtttactgctctccaacttcatagacaatgtgtcgtttgcaagcaagctgatgaagaattccagattttggcaaatttttggcgatactccagtgcatttaccaaccgcatattttttgccatggtggattttgatgaaggctctgatgtatttcaaatgctaaacatgaattcagctccaactttcatcaactttcctccaaaaggaaaacccaaaagggctgatacatatgagttgcaggtgcgagggttttcagctgaacagattgcccggtggatcgcagacagaactgacgtcaacattagagtaatcagacctccaaattatgctggacctctaatgttggggttgcttcttgctgttattggtggacttgtgtatctgcgacgaagtaatatggaattcctctttaataaaaccggatgggcttttgcagcattgtgttttgtacttgcaatgacatctggccaaatgtggaaccatataagaggaccaccatatgctcataagaatccccatacaggacatgtgaattatatccacggaagcagccaagcacagtttgtagctgaaacccacattgttcttctcttcaatggtggggttaccttaggtatggtgcttttatgtgaagctgctgcctctgacatggatattgggaagcgaaggatgatgtgtattgctgggattggacttgttgtgttattcttcagttggatgctgtccatctttcgatcaaaataccatggctatccatacagctttctgatgagttaaagaggattccagagaaacattgacaccggtaatggaaactgaaaaataaaacctgttgggggttggagaatgcactcaagttttttcttaccccttgggcaaggaacgacttataacaattaccaagtccggggccttaaagaaaggaacagaggtttgg

SEQ ID NO: 332 - DNA, 607 bp, Rattus rattus
ggccgcacaactttttttttttttttttttttttttttgctggttcaaaaagctttatttttacttggtccaagacttgggagaggctccagggcggttacaaagctgcctagtggctttagaggttcattcgggtggaggtgctgaggcggtcggtgcagagcagaggagggagccccttggaaggcacagaggcctagtcgtgcttcagagtgaggcgctcaaagagatactcgcccagagatgcctgggccacgccagtctgcgctggttgtggccctgccaccctacggaggttggtcaggtggttgcccatcttcttgatgagcttcacctccttatccaggaagtggctttccaagaagtcacagaggtgagggtctgtgcgggcagagcccagggcgtgcagatccaagagggcctggttcaggttcttctccagggccaaggcagcttccatggcctccagggttttaccccactcatcttgagatggcttctgcacatcctggaagagtgcacggcccccgcgttcgttctgcaacttgaggagacgctcggcgccctcgcgcttctcctcggccaattcgcggaagaagtggcctac

SEQ ID NO: 333 - DNA, 1009 bp, Rattus norvegicus
gaattccggtagaaggcagcggaggagccgagccgggctgcgctcgctcgccgccccctagcctctttcttctccgccgggtgcactgccctgcgctgtcccctcgcctcttcgcccccttgacaaagaggacagaaagtttgcgcgggggagcgggccaggtgaggaggggcgtgccggcgccagcccgcgccccagcagccggacccaggcccctagcgcgcccgccatgggcgccgcggcccgcagcctccggctggcgctcggcctcctgctgctggccacgctgctgcgcccggccgacgcctgcagctgctccccggtgcacccgcaacaggcgttttgcaatgcagacgtagtgatcagggccaaagcagtgagcgagaaggaggtggattccgggaatgacatctatggcaaccccatcaagaggattcaatatgagatcaagcagataaagatgttcaaaggacctgacaaggacatcgaatttatctacacggccccctcctcagcagtgtgcggggtctcgctggacgttggaggaaagaaggaatatctaattgcagggaaggcggaaggagatggcaagatgcacattaccctctgtgactttattgtgccctgggacacgcttagcatcacccagaagaagagcctaaaccacaggtaccagatgggctgcgagtgcaagatcacacgctgccctatgatcccatgctacatctcctccccggatgagtgcctctggatggactgggtcacagagaagagcatcaatgggcaccaggccaagttctttgcctgcatcaagagaagtgatggttcttgcgcgtggtaccgcggggcggcacccccgaagcaggagtttcttgacatcgaggacccgtaagcaggctgacagagccccctgtggccaattgaaaagcctctgagggttcagactggtccagctttgacatcccttcctggaaacagcatgaataaaacatcaatcatcccggaattc

SEQ ID NO: 334 - DNA, 2462 bp, Rattus rattus
tgtgctgttggaaccatggcgcctgtctgcctgtttgcgccgctgctgctgttgctcctcggaggtttccccgtcgccccaggcgagtcgattcgagagactgaggtcatagacccccaggacctcctggaaggcagatacttctctggagccctcccggacgatgaagacgctgggggccttgagcaggactctgactttgagctgtcgggttccggagatctagatgacacggaggagcccaggaccttccctgaggtgatttcacccttggtgccactagataaccacatccccgagaatgcccagcctggcatccgtgtcccctcagagcccaaggaactggaagagaatgaggtcattcccaaaagggtcccctccgacgtgggggatgacgatgtgtccaacaaagtgtccatgtccagcacttcccagggcagcaacatttttgaaagaactgaggtcttggcagctctgattgtgggcggcgtagtgggcatcctcttcgccgttttcctgatcctgctgctggtgtaccgcatgaagaagaaggatgaaggcagttacgacttgggcaagaaacccatctacaaaaaagcccccaccaacgagttctacgcatgaagcttcttcccatgagtgctgcttggacttcatggggagaggagttgaggattgtggacagtggacattggcagagagagggcaccttaatactgacttgtatctccatctctggtcacctttctggtgtcagaagagatatgatcttctactgtgctgcctcagagagagagagagagagagagagagagatgggatggggtgcggagggagtgtccgtgtgtgtgtgtgtgtgtgtgtgtgtgtgtgtgtgtgtgtgtctgtctgtctgtctgagttgccctggcagaaaaatggggttaaacttgttctttcttgaaggcaagcctggaattgggtctttttgttgttgtttcaaatttctagaatagaatgtaggaccagtttagttcctgccgttaacatgtctcatttatgactgcctttattctagaggcaaggagttgggggcaaggagctggaacccgctgcaccttgagatgtgttcacccgagtacttcctcacactacagggtctctgtggtgtatctcggggcattctaggctcagtgacttttgaaattcaaccttttttttttttttttaaatccagggagggtgggactgaagtgctgacagctcatgctgaagtacacttgtagaagatttgtaaaatgtaaggttttttttttttttttttaatggtccattccttcatgggagcgtgtgccctgggctgagagcgtggggatgcacagatgttctttctagaacatattcgttgcaacagctaactttgtgttttcatggttttttatgttttgttttgtttttttgaaaatgagagaagagctggagagatgatttttatgatttttttttgttttgttttttactatttatagcttcagacggggctgcttttctctacctttctgtctttactgtttcccactattttttttttttaatgttctgtgctcttgtttttgaccctggccctttctgaagttgctttatcttaaaaagtagctacagtgttctagcagattccagaatataatgtagggggtagcgggatatttgtgttcttgtaatatatattatccttcctcggttctaggagaatagataaatatatttttttaggatatagaatgatactacaggtctcatgttggctgggtggctgcgtgagtgagttttcgtgcggctgagtaagctgttgccctcttctcttgccctgctcctggtgccttctcgagatcgagctggagtgactgagggtacctgactctaacctcactgtgccttctgccgggggctctgcccaggagcctctgggtttgctttctccaggctctctagatgcacgatccaatacagtgacctcctgtggctgtatcaatcagttcacttgactatgtgattggaaatcattcctctgttgcactggccacacaatttaagtgcctagtcaccatccaccgagcacagagattgaggctggtttagcaggttacggttcagttttgcttgtctccccgggcaagagaaggggacttaggaggaaggtgatgaggtcccagggactcctgtcacccaggactctccctcttacagaggaaagacctagtagcttaaaaggtctgggctgtgtgggggtggggcggtcataccactccctcaaccatgccctatgcctgtaagcccccatcaccacctccgtgcagggtcctagctggctgggtcctcttctagccttgtgcctgctccttttctgtatcccttactctgttgtctgttactgatttttttgataaaaagataataaaacctggtactttctaaaaaaaaaa

SEQ ID NO: 335 - DNA, 2340 bp, Rattus norvegicus
ggatccagatgagagattctggtacggaggtgtgtgtgtgtgtgtgtgtgtgtgtgtgtgtgtgtgtgtgtgtgtgtgtattgcacaagaatgaaaactgaaaaacaagcagtatataaatggctcccggagattctgagatgctgaggcttgcttgtatgttgctatagtgtatgttggtgcttgggagccactgtcatggataggtatgttgctgggtcatccaagccagtgtgtggacactcaggtacaggaagcaaagtgaaggcatcagcaggcatttttgttttacgatgtttaaattacacttattttatttgtgtgtacgagtgtatgggtggggatggggcaaatgccaaggggcacttcttgtgagagtcaatctgttccttctagcatgtgggctctggagatcaaactcaggtcattgagcttggtggcaagcacctctacctactgagccacctgttcaacacccacctgtaggcatttgtgttcatagtagttcatagccctatgaacatatagcacctaggccaagagagcctggcttccccaccccctccccttgtaccccaacctctgccacttcatctcactcctactaggcagctgggttttttccctcactgtaggcccctgggcaggcagccagcagccgcgcccaacgctgggagggagaagaatgggtcagaggctggagcttgtggttgagttggggagtgagtaagctgagtgagggatggaaaactgctgttgttgaggccaggcctgggggggaggcacagaaggctgctggcatgaatttctagagtttgagtggtaagttttgcaagtttcagagcttgaagcacatatgagcttcttgccatcagtgggtaccactcctctgatctccctgggagtgaggtcggtctctggaagtgctcttagagagtaggttggagtagagcactaaaaacggggacagactgagtgtgacttgagtgatgcctagcaacatatatccagctctcaacacactgttggtgtgggttggagaaggctacttttgtgtctcctgcccctaggtctcaacggtcaccatggcgagacccttggaggaggccctggatgtaatagtgtccaccttccacaaatactcaggcaacgagggtgacaagttcaagctgaacaagacagagctcaaggagctactgaccagggagctgcctagcttcctgggggtgagtggatcctgtctgtgtattgcatatgtgatgcatccccaggaggaggctggggctggagatatctatctatctatctatctatctatctatctatctatctatctatctatctatctatctatctatatctatatcatctatctatatctatctatctatctacatatatatatatatatatatatatatatatatatatatatatatatatatctctccctactcctggcgcttggtatggaaccacaatgaaccatctacttcacaccagccccccgttgagacaaggcttagaatgaagttaactgaagtggcacaggaaaaccacattaggtagtcagtgtctgaaagcacagcctagatcaggacagtctttccggtgatgtgcaacagaaatcgagtttctgcttgtgaagacatgattgtggaggcacacaaatgcctgcagatcttcccctcaatgacaccttatcttagttaacacctccttgtcatgacagttacctatagacatagttaaaacaagcgtggggaagatgtggtcacatcctttcccagctagcccatgtgctcatctcacagttgagccctgaggctagcacggtgtctgcaagccttcctgagctcctggctggaggtggcgtctaactgtacctcttctacctccagagaaggacagacgaagctgcattccagaagctgatgaacaacttggacagcaacagggacaatgaagttgacttccaggagtactgtgtcttcctgtcctgcattgccatgatgtgcaatgaattctttgagggctgcccagataaggagccccggaagaagtgaagactcctcagatgaagtgttgggccagtgggggaatcttccatgttggctgtgagcatagtgccttactctggcttcttcatacatgtgcacagtgctgagcaagtttaataaagagttttgaaactatgtctgagagactggagattgtgggtgggtgggtgggctgagggagggtggtggcagagatggctggaagttgacctggagctttgtggggccaactagaaaaggttggggaggggtgagtgactatctgagtcatacagtgtat

SEQ ID NO: 336 - DNA, 2700 bp, Rattus norvegicus
  misc_feature (257)..(257): n is a, c, g, or t
  misc_feature (407)..(407): n is a, c, g, or t
  misc_feature (414)..(414): n is a, c, g, or t
  misc_feature (464)..(464): n is a, c, g, or t
gaattccgcggagagagcgcgcggctgcggtccctctgcagagggctgcgcgctccgcggtctccagggctccccgtggtttgggtccgtgctcctcgacctcgggagcagggctgtcctgagaccgcaacgatctgggtaactagaggcaagaccagaagctctgggtcagaatctgatgcactgagcccccggtaacggcgggagacccggggtcctggtcaccagattgtgagggacacggactacaaggtcgncagtcctcaggcgggtccaggttgggctttaaataatggagaagtttatcgacgaaagtgctttcatttaaagagtaaattaagagacaacgccgtgaacagctgataaacaaggcatttgggtcctgaagaggcacagaaacaagtgtnatgtgangggagagtagacacataggaggaatcagacctggtgtgatatttttgtcncaaaagacttgaggaagagagaagccacttttccagagaatgaaagagtgcagtgtcaaaatggagaccagcgtttctgagattcaaatcgagactaaggatgagaagagaccagaagcagccagtcctcagaaagagaggcaggagagaaaaacagccacactgtgcttcaagagaaggaagaaagtgaacaagaagaaggccaaagctggttccaagactgctgaggagacagagaagcatgccccagaagctgggggttctggtcagcggcaaccagcgggggcctgggcctccattaaacgccttgtgacacacaggaaaccgtccgagtctgcagagaagcagaagccatctgaggctgaaatgcagcctgaggatggagctcttcctaagaagaagacaaaatccaaacttaagattccttgcatacgattctcaagaggggcaaagagaagtcgtccttccaaactcacagaagattcaggctatgtccgagtccagggagaggcagacgatttggagataaaagcccagatccagcccgatgagcaggcaacccaggctaagtccacccagggcctacaggaagatgtgatagtgagagatggtaaggagatccaagaatcacacataagcaacaacgtcatatcgggagagcatgtgattggcatagaactggaattagaaaaggaatcttctgctctccggatgagaactccagggagtgaaaaggaggctaaagtgattctggtaaagcagggtgttcaggtacaggaagcaagtgtgcttgagaattcagcagcagacagccctcagccagtgacttctactgctcctctctcaccagcaaccacacatcaactcggtctggaagaacccagtgacagcatccgggaaagtgcaccaagtggaaaagatgacggaaggagaaagactgctgctgaagaaaagaaatcaggagagactgcgctgggccaggcagaggaggcttcttctgtcagccaggcagacaaaagtgtactaagccaggcagaagaagctacagtgggccacacagaggaagctactgtgatccaggcacagagtcaggcaaaggaaggtaaactgaaccaggcagaggaagctacagtggcccaggcaaaggaaactgtattgagtcaggcagaggaagttaaactgagccagatagaagaacctgcaattagccaggcaaagaaagctacagtaggacaagcaaaggaagctatagttagccaggcagaggaagctatagttggtcacacagagaaagccaccatgggtcaggcagaggaagctacagttggccacatagagaaaaccacagtgggccaggcagaggaagctacagtgggtcaagcagaggaagccacagtgggtcaagcagaggaagccacagtgggtcaagcagaggaagctacagttggacaggcagaggaagctacagttggtcaggcaggggaagctacagttagccacatagagaaaaccacagtgggccaggcagaggaagctatagttggtcaggcagaggaagccacagtgggtcaagcagaggaagccacagtgggtcaagcagaggaagctacagttggccaggcagaggaagccacagtggatcaagcagaggaagctacagttggccaggcagaggaagctacagttggtcaggcaggggaagctgcagttggccaggcagaggaagctatagttgctcaggcagaggaagccacagttggtcaggcaggggaagctacagttggccaagcagagaaagccacagttggccaagcagaggaacccatagttggccaggcagaggaaactgtattgaggcatgcatcagatctgaaagtaaatggagttgatgcagagaaaccaagatcagaagaaagcaaaagaatggagccaattgctattatcataacagacactgaaatcagtgaatttgatgttaagaaatctaaaaatgtccctaagcaattcctaatttccatggaaaatgagcaagtgggggtttttgctaatgatagtgatttcgaggggagaacttcagaacagtatgaaacactcttaatagaaacagcttcttctctcgtcaagaatgctatcgagttgtctgtagaacagctggttaacgaaatggtttctgaggataatcaaataaatacgctgttccagtgactccatttccaggtcacgggaagaggaattc

SEQ ID NO: 337 - DNA, 1414 bp, Rattus norvegicus
gcgcctccttgttcccagcgtcaccactgccgccatgcccggagggctgcttctcggggacgaagcccccaactttgaggccaataccaccatcggccacatccgcttccacgatttcctaggagattcatggggcattctcttttcccacccacgggactttaccccagtgtgcaccacagaacttggcagagctgcaaagctggcgccagagtttgccaagaggaatgttaagttgattgctctttcaatagactctgttgaggaccattttgcctggagcaaggacatcaatgcttacaatggtgcagcacccacagaaaagctaccatttcccatcatcgacgataaggacagggaccttgccatcctgttgggcatgttggatccagcagagaaggatgaaaaaggcatgcccgtgacagcccgtgtggtattcatttttggccctgacaagaaactaaaactgtccatcctctacccagccaccacgggcagaaactttgatgagattctcagagtggttgactccctccagctgacagcatcaaatccagttgccactccagttgactggaagaagggagagagtgtgatggtccttcccaccctccctgaagaggaagccaaacaacttttccctaaaggagtcttcaccaaagagctcccatctggcaagaaatacctccgttatacgccccagccttaagtctgcgggaactggggctgcaactgctcgaccagcactgggacctgaggatgacagctgacagctgcagttccgtagaaagattgtggcgtggtcacagccgaagtcgcgtaggtcgctcgctatactactggctcattaaatggaaatggcaccaaaacattctcgggattctttactctgtgccttcgccagcattctgcccctccatccatcacagcgccctgctgactggctttctttgaaacgaattatgtgttggtgactgcagggtctctgcagggtctgtgatcagcaaggtagtgtcagtgtgggctccatgctagaatgataaacatcttttgtaggtttccaaactgaatcttctgttacccattgtggagaaccataaagtggggagaaactttcaattctgtactttcagtaaataaagcaggggaggtggggggggggggagagttctctataggaaatccatggtgagtttctatcaaagtgggcttccaagaatgtgtggaagacagcacatgtacttcctggagtttccaggtctgctctctagtgatctgtgaatgtgaactcgccttatgaaagacaggcagtgacattgtttgccactaaatgtcctaaaggagtgggttgccatttctaaattctgctgtgtgaggttcaacaataaaatcctgattagaaaaaaaaaaaaaa

SEQ ID NO: 338 - DNA, 921 bp, Rattus rattus
ctcgcgtgcggcgttcagccccggctctggccatggctacactgagggtccatcctgaagcccaagccaaggtcgatgtgtttcgtgaggacctgtgtagtaagacagagaacctgcttgggagctattttcccaagaagatctcagagttggatgccttcttaaaggagccagctctcaacgaagccaacctgagcaatctgaaggctccattggacatcccagtccctgatcccgtcaaggagaaagagaaggaggagcggaagaagcaacaggagaaggaagagaaggacgaaaagaagaaaggggacgaagacgacaaaggtcctccctgtggtccagtgaactgcaatgagaagattgtggtcctcctgcaacgcctaaagcccgagatcaaggatgtcattgagcaactcaacctggttactacctggttgcagctacagatacctcggatagaggatgggaataattttggcgtggctgtccaggcaaaggtgtttgagctgatgaccagccttcataccaagctggaaggcttccaaacgcagatctctaagtacttctccgagaggggtgatgccgtggccaaagcagccaagcagcctcatgtgggtgattatcggcagctggtgcatgagctggacgaggcggaataccaggagatccggctgatggtcatggagatccgtaacgcttatgctgtgttatatgacatcatcctgaagaactttgagaagctcaagaagccccgtggagagacaaaggggatgatctattgagccccctctctcgttctatgatgggtataacagaaaccttcctactcttgactaggaactctagactgcacccagtcttcttcctgctggggtctcctccctcactctgccttccaaacacaataaatacatagttgcc

SEQ ID NO: 339 - DNA, 4181 bp, Rattus norvegicus
gaattccgagtgacatctggttaacgccatcaaggacagcaacaatctgaagtcggggtctcctgtgttggaagctcggaaaaataaaaacccagagagtgagcgtcaaaggttacatctgctctggggtttgctgagtgtcacctgaaggcccctgtgtctgcttcagagtgctgctgttgaatgacaaagacgctaagaacagtctttgcccaagacgggtctggaacttaacggggttcccatgacccctgtgattgcttccagtcagcaatgaaagggttatcgggtagccgcagccaccaccatgggatcacctgtgagtcggcctgtgactccttgtcacaccattcagaccacaagccgtacctgctgagcccggtagaccaccaccctgcggaccatccctactacacccagcggaattctttccaggccgagtgtgtggggcccttcagcgaccctctggccagcagcaccttcccgcgcaggcactacacctctcagcaggagctgaaggacgagagtgccctggtgccgcgcacactggccaccaaggcgaatcgcctccccaccaacctgctggatcagtttgagaggcagctgcccctcagccgagatggctatcacacgctacagtacaagcgcaccgctgtggagcatcgcagcgatagccccggccgcatccggcacctggtccactcggtccagaagctcttcaccaagtctcattccctggagggggcatccaaaggcggcgtcaatgggggcaaggccagccctgacgggtcgcaaactgtgagatatggcaagcgcagcaagagcaaggagagacggtcagagcccaaggctagatccaatgcctctaacgcctccccgacctctcccagctggtggagctcggatgacaacctggatggggacatgtgcctctaccacacgccatcgggtgtgatgaccatgggtaggtgccctgaccgctctgtttctcagtacttcatgggggcctacaacaccatcagcgagcaggcagtgaaggcctcccggagtaacaacgacgtcaagtgctccacctgtgctaacctgccagtcacgctggatgccccacttctgaagaagagtgcctggtcctccactctcaccgtgagcagagcccgagaggtttatcagaaagcctcagtgaacatggatcaggccgtggtgaagtcggaggcttgtcaacaagagcggtcatgccagtacctacaggttccccaggatgaatggacagggtacacgcctcgcgggaaagacgacgagatcccgtgccggaggatgcgcagtggcagctacatcaaagccatgggggatgaggacagcggggactcggacacgagccccaagccatctcctaaggtggctgcaagaagagaaagctatctcaaggccacacagccatcccttacagagctcaccaccctcaagatctccaacgaacactcccccaaactccagatccggagtcacagctacctgagggcagtaagtgaagtctccattaacagaagcctggacagcctggatcctgcaggcttgctcacgtcaccaaagttccgctccagaaacgagagctacatgcgagctatgagcaccataagccaggtgagcgagatggaggtgaacggacagttcgaatccgtatgcgagtctgtgttcagcgaactggagtcgcaggcggtggaagcgctggacctgcccatgcctggctgcttccgcatgcggagccatagctacgtgcgggctatcgagaagggctgctcccaggatgatgagtgcgtgtcgctgaggtcgtcctcccctccacgcacaaccaccaccgtgaggaccatccagagtagcaccggtgtcataaaactgagttctgccgttgaagtgtcatcttgcattacaacatataagaagacaccacctccagtcccacccagaactaccacgaaacctttcatttctatcacagcccagagtagcacagagtccgcgcaggatgcctacatggacgggcaaggccagcgcggggacatgatcagccagtctggcctcagcaactccaccgaaagtctggacagtatgaaggctctcacggctgccatcgaggctgcaaacgcgcagatccacggcccggcaagtcaacacatgggcagcaacgctgctgccgtcaccaccaccaccaccatagccactgtcaccaccgaggacaggaagaaagactttaagaaaaacagatgcctatctattgggatacaggtggacgacgccgaagagtcagagaaaatggcagagagtaagacgtccagtaagttccagtccgtgggagtgcaagtagaagaggagaagtgcttccgcaggttcactcggtccaacagtgtaacgactgcagtacaggctgacctggacttccatgataatctggaaaattctctggagtctatagaggacaattcgtgtcccggcccaatggccagacagttctcgcgagatgccagcacctctaccgtcagtatccagggttcaggaaaccactaccatgcctgtgcagccgacgatgactttgacacggattttgacccctctatcctgcctcctccggacccctggattgactctatcacagaagaccctctggaggccgttcaaaggtccgtgtgccaccgggacggccactggttcctgaagcttctccaggcagagcgagaccgcatggaagggtggtgcaagcaaatggagagagaagagagggaaaacaacctcccagaagacattctagggaaaatcagaaccgcggtgggcagtgcccagcttctcatggcgcagaaattctaccagttcagagaactgtgtgaagagaacctgaatcccaatgctcacccgagacccacttcccaggatttggcggggttttgggacatgctgcagttgtccatagaaaacattagtatgaaatttgatgaacttcatcagttaaaggccaataattggaaacagatggatcctcttgacaagaaggagcgaagggcccctcctccagtgccaaagaagccggcgaagggccccgcgccgttgatccgggagcgctcgctggagagctcgcagcgccaggaggcccgcaagcgcctgatggccgccaagcgcgcagcatcagtccgccagaactcggccaccgagagcgccgagagcatcgagatctacatccccgaggcgcagacccggctctgagcgcggccgacgaggaccgtcccgcatccctgccctcggccgtctccccgccccctccgtctctgagctcagtgaccgccaccgtcgtggcgtagttgtccacctcgcaggagccgtccccaggccgccccgcttcctggaccactttgcccatcttctccaccgagcttcgctccccagtcctgaagcctcatgcagacatccaaaccctttattttctgggccaagcaaacttgtgtagaaacgacacctgtaggtcactcaccctcctcagttctctcaagctagtgtgcccctagaactcagcaatataaaaccatagggtatttcagaaacccagtattacatagggtgatcctttgggacttaccgtcttccacgcgaaagaaacgagggctccgactccctttatttgcccccaaacggttatttttacaagcaaagagcgctttatttctaatctcagaaatcctaccatctcattggaatcaaagtgacagaggggaccaagctggcctagggttgggggcctgggtatgtaggagagaagggcggagcgcgcaggtgccctgcatctgtgccctcgcagctgtacaaactgcctcactggtacttcatcaaccgcagcttcaaatgtttcaatcagcagaagattgtaaattcgatctttcagggaaattaatctattctgaaaggcaataaaacgaagaaagttaaggcaaaaggaaacaccggtggtttaagatcctctataaggaatccatttatttatcttaagaaaatttagacctgaattttttttttaatcaactcttcttgtactctgtgtattataatggcatggcaatgattttcaaatgggagggtgggaaggaattggttctgttagtttcgtgttcatcctggtggggccacttaagatttcacac

SEQ ID NO: 340 - DNA, 3803 bp, Rattus norvegicus
acagcccaaggttcaggcaaagtcttagtcgccaggctgtgaggtaagggcggggcaggggattccccatctccccagtttcacttcagcttttaacctgtgtcaggtccttctgctcgggtactgatgacgctctggaaattctcattcccattgggtgccgtaaaccctgtgaatcaatcagcgtcgccccaggcactgcacgtaaagtcgaagcagcccgacggatttagccaggtccgggatctcagatgggggcaaaggcacttcaggcgctgctcctgctggtggcggtcgccctggccccgacccagaccagcgcaggtgagtgcggggtcgggagggaaacggcctctgcgtggaagagcgggtgaggggaatcggggaagccgggtccccgcgtcgcataccagaccctcgccctttctcaacccgcgtccagagccccgcgccctgctccccgcccggcccgcacacccgcccgggatcccgggaggaggtcggggtctcaccgcgcgccgcccccaggctcacactcgctgcggtatttcgaaaccgccgtgtcccggcccggcctcggggagccacggttcatctctgtcggctacgtggacgacacggagttcgtgcgctacgacagtgacgcggagaatccgagatacgagccgcgggcgcggtggattgagtgggagaagccggactattgggagacgcagacacggagagccaagggaaacgagcagatttaccgagggagcctgacgaccctgctccactactacaaccagagcgaggacggtgagtgaccccgggtcggaggtcacgaccctccgggtccccacactgccagggacttccgggtccgaagtccgaggttcttagcagaaccgacccaggcccgtttccctttcagtttggaggagtccgcgggtgggcggggctggggcggggccgggtctgaccgcggggtcccgcaggctctcacaccatccagtggatgtatggctgtgacgtggggtcggacgggagcctcctccgcgggtattggcagcacgcctatgatggccgcgattacctcgccctgaatgaagacctgaaaacgtgggaggcctcggacagagcggcgcagaaaacccggaacaagtgggagcggaaaggtgttgcagagagaagcagggcctacctgaagggcacatgtgtggagtccgtccgcagatacctggagctcagaaaggagacgctcgtgcgctcaggtgcggggactgcgggcttctcctcctctgccctcgggctggggctcagtcctggggaagaagaaaccctcagctgggtgatgcccctgtctcagaggggagacagtgtctcctgatccctcatcacagtgactggactgcctctcccagggcccagccttctccctggagagttctgagtccctctcaggagggaaggagagaatttccccacttaacagcaggggctccctgctgtcagccatggcctctcccaggccaggttctctgcccacacccactctctgaggacactgactcctgtcctgctgagtgtgtcagcccttacacctcaggaccagaagtctcctttacctcagaggagacatggactccactgcactaggctggttcccccagtttctagaatttccatagaacacattctcacagatccctccctgaatgtgggttttgcatcccttcaatacctcatttctctctattcctacagtggagaatggtcccatgagcccttatggggtaccctggaggaatataaatcatgggatttctttttctattttctcttttttaatatttctttcttttttctttcccttttttttgaaggcatacttttgcttctagtcagtctttactgcaaacacatattaaatcaattattttccattccctcttctgttctatgaccacccacctcatgctatagaacatcacataaggacggccatgttgacccactggctcatgtggattccctcttagcttgtgagtccctcaggaaagtgtgcagttctctactgaggggaccagctctccctgcagctctctagtgagatgacagttgaagtgtcagacacacacagttcagtgtcatccttgatttaactgtgtcttgtgtagatttcagtttgtcttgttaactgtgtgatttcttaaatcttccacacagatcccccaaaggtgcgtgtgacccttcaccccagacctgaaggtgatgtcaccctgaggtgctgggccctgggcttctaccctgctgacatcaccctgacctggcagttgaatggggaggacctgacccaggacatggaacttgtggagaccaggcctgcaggggatggaaccttccagaagtgggcatctgtggtggtgcctcttgggaaggagcagagttacacatgccttgtggagcatgaggggctgcctgagccgcttacccagagatggggtaaggagggagccttctgtagaccctgagctggtcaagtctgagagctggggtcatgaccccactttcatttcctgaacctgtccttgcagagcctcctccatcaactgattccaacatgggaatcattgctgttctggctgtcgttggagctgtggctgtcattgtacttgtggccctcattggagttgttgtgaggaggaggaggaaaaacataggtaggaatgggcagggactgagtgtctcctcagcccactttagaagagtgctgttctcattaatggggcttgcagccacaccctgcattgcgactgtctccaactttgtccattctggaaacttcctcctgtgaagaccttccttgaactctcacagctttccttctcacaggtggaatatgaggagattacgcccctgctctaggttagtgtgggggcaggattatccctgagggtattggagtgaagctggagatgtggggagctcttggaatccatagtagctcctccagagaaatcttctggggtctagttttactgtgatgtacacatacacatatacatatacatatatacatatacagaaacacatacatatatacgtatgttttgttttaccctaggcagggacagctgccagagctctgatgtctctcccagattgtaaaggtgacactggggtctgactggggagtggcaatgtggacatgattgggtttcagggactcccagaatcccctgtgagtggagggttgttgggctgttgtcttcacagtgatggtttgtgactctccttctctagcatgaagacagctgcctggagtggactgagtgacagatgatgtgttcaggtctctcttgtgacatccagagccctcagttctctttagacaccagtgtctgatgttccctgtgattctatggcttcagtgtgaagaactgtggagcccagcctgccctgcacttcaggaccctgtccctgcactgccattccttcccttcctaggccaaccttagtggtccagcctgggggtggggggtggggacatctacatcctgtccctccttgctgccctgagtgtcagcccctcacttccacactgagaataagaatctgagtgtgaacttgattgttcacatccttgactcaagtgtggatggctttttcaattactggatggaatacttagaggtttttcagttttggggttttgttttgaaaaaaaataaatggcagatggagaagcttccagaatctgtgtcactaagctgtgtgtatctggtgggacaggatgaggatgtgggaggtgagtgtgaaca

SEQ ID NO: 341 - DNA, 3618 bp, Rattus norvegicus
aattcggcacgaggtcatatcatggaaactacctttcaaggcaacagctttagtgtctcctgtcagcacaccagggaggagagaaatagaaaaggaaacaaacacaaaaaaccatgacatctcttctgttcaaattcagtagctgctagaaaagatggatgcagaggttgaagataaagcgttgcatactctctcaaaaggaacgaagttccaatggattctctgatcccagagctcagggttgcatatgattgctctatggcgaagaagaggagagctgaagagcaggcattgggagtgccagttaacaagaggaaatctctgttaatgaaaccccggcactacagcccagacatggactgcaaggaaaacccagacaacaggaatgaggatgatggcctagaaacgaatgaccactccactgcagatgaaatcgtggtaaaacccatggataagactcttcatttacctgcacaagaaagctcactccccaaggaagaccaatacgcgtgttatccagagctcatggtcaaatctctgatgcatttaggtaaatttgaagaaagtgagtctgtgcagaccgtaggtgagaacttaaatggcaacggcatccagtctctaaaagcagagtgtgatgaagcaaatgaatgctttatggaacattctgatgatggaagagacaaagtccaccattcccagccacctttctgctcttccggtgacagtgagagtgactctgacaatacagagaatgggtggggcagtggctccaactcttcagaagacactgacactcacaaaggccccaaacgcaagctgacatacaatagaaaggacctgctggaagtccctgagataaaagcagaagatgacaagtttatcccttgcgagaacaggtgtgattctgacaccagtgggagagacccacagaactctcacatggaacccttgtctgtgaaagtccagccttccttcccagaggttgaagagagtgagagcctggccacagtaatagcggagtctgctgaggtggagaaagcgaaggggagcctgagtttgctggaacaggctattgccctacaggctgaacggggttccgtcttccatcacacctacaaagagctggaccgatttctcctggaccacctggcaaggcaacggaggcaacccaaggttactgatgccagtggaaggcaaatctttaataataaacattcaccaaggcctgaaaggagggaggctaagtgccccattcctggctgtgacggcacagggcacgtaacggggctctacccccaccaccgcagcctttctgggtgcccccacaaagtgcgagttcctctggaaattcttgccatgcatgagaacgtactcaagtgtcccaccccaggatgcacaggaaggggacatgtgaacagcaatcgcaacactcacagaagtctttctggttgtccaattgctgcagctgaaaagttggcaatgacccaggacaaaagtcaacttgattcttcccagactgggcagggtcctgagcaggctcacagggtgaatttagtgaagcaaattgaatttaacttccgctcacaagccatcacctctccaagagcctctgcatcaaaagaacaagagaagtttggcaaagtaccatttgattatgccagttttgatgcacaagtatttggtaaacgtccgctcctacaaacaggacaaggacaaaaggcaccaccatttcctgaatcaaagcatttttcaaatccagtgaaattttctaatgggctgcctagtgctggcgcccacacacagagcacagtccgtgccagctcttatggccatggtcagtacagtgaagacacccacatagcagcagctgctgctatcctgaacctttccacccgctgcagggaagccacagacatcctctccaacaaaccgcaaagcctgcgtgccaagggagctgagatagaagtggatgaaaacggcacgttggacttaagcatgaaaaaaaatcgaatcctcgacaagtctataggggggacttcctcacacactacaattgcaaccccatcctcatccccattcaaagcaagcagccttctggtcaatgctgccttctatcaggctctctgtgaccaagaaggctggaatgtgcctatcaactatagcaaatcccacgggaagacagaggaggagaaagagaaagaccctgtgaactccctagaaaatttagaggaaaaaaagtttgctggagaggcctctattccaagtccaaagcccaagctccacacacgagatctcaagaaagaattaatcacctgccccacgccagggtgtgatggaagcggccatgtcacaggcaactatgcatctcaccgcagtgtctctggatgtcctctagcagataagactctgaagtccctcatggctgccaactctcaagaggttaagtgtccaaccccgggttgtgatggttctggtcacgtgactggaaactatgcctcccatagaagcttgtctggttgccctcgtgcaaggaaaggtggcatcaaaatgaccccaacaaaggaagaaaaagaagactctgagcttagatgtcctgtaataggatgtgacggccaaggtcacatatcaggtaaatacacatcacaccgcacagcttctggctgtcctctggctgccaagagacagaaggagaatcccctcaatggacctctctcatggaaactgaacaagcaagaacttccccactgtcctttgccaggatgcaatggtctgggtcatgtaaacaacgtttttgtcacccacaggagcttatccggatgccctcttaatgcacaagctatcaaaaaagtcaaggtctctgaggaactaatgaccatcaagctcaaagcaactgggggtattgagggtgatgaagaaattaggcatctggatgaagaaataaaggaactgaatgaatccaaccttaaaattgaagcagatatgatgaaacttcagacccagataacatctatggagagcaacttgaagaccatagaggaggagaacaagcttatagagcagagcaacgagagtctactgaaggagctggcagggcttagccaggctctcatctccagtcttgctgacatccagcttccacagatgggtcctatcaatgagcagaattttgaagcatatgtaaatactctcacagacatgtacagcaatctggaacgggactattccccagaatgcaaagctctactggaaagcatcaagcaggcagtgaaaggtatccatgtgtaggacaacagtatgcaggaaacggaggtcactacagccatgaactcccacagatccgcaggagaccaatacccctggacctggaggctgtcccctgcgtttataattgcaacattgcactaatttttccccagttgacataaaaaagaaagaaaaactatgataaactctttggattaaaagcaatgcagtcaattattagatctcatttattttcatatctttttcttttctttcttcattgcactctttattttgtaaaatatatgtaaaaataaatgtgacattttatattttaaaaaaaaaaaaaaaaaaaaaaaaaaaaaaaaaaaaaaa

SEQ ID NO: 342 - DNA, 568 bp, Rattus rattus
  misc_feature (483)..(483): n is a, c, g, or t
atcaggatagaaatttatttaaatccaaaataatatgactatagttagaataatataataattatctaaaggaaatatcatcattggctctgaaacagtctaacggtgtcatttttctggagtcaaaaacatgtagtaaaaggatatacaggaagcaaaaatacagaagcaagccggctgagtgaggaagctgtaacaggagggtacactaagatactgtaacaatcgagacaggaagacaagtatagcaagctgtcttacctatcaacccctgcacagtaagtcagtaacccagaatgaaggaataatagcacgtggttaacaggacaaatttccctctaatttgtctttgtaactgatttctttccttttttaccatgggttccatctggttaacaaaacatttggttttatttgtaaagcagagtaaataaaatatcctgatcagagtgctcaattttgtttaaggtgctcaaggttcanacttaaaaaggtcaactgggctagtcagtgggaaccattgggtgtgtttgctaaacagatgaaagcagcagcatttaaaatggat

SEQ ID NO: 343 - DNA, 1469 bp, Rattus rattus
ggacggcgttccccacccttaccgttggttggctgtccatgttcacaggggctgttggattcttcatttcctgtaccgggatcgtttctgacgcaaatcaaaccagcctagcacttttaatagcactctgacggctccggtttaatcgtctcctctctctctctctctcttaggaaatcaaagagcaggaagtggtggacaaagtgatggagacgctggacgaagatggggatggggagtgtgacttccaggagtttatggccttcgtctccatggtgaccacagcctgtcatgagttctttgaacatgagtgagacaaaaaaaaaaaaaaaaagtggctgagccgtttccccgtggcagacatgagggccacgagaggaggcacggcagaaggctcgtgggctggaaggagctgcgctctctagacgcatataactaattaggaagcttgatttgcttcagggatgaaactctgaccccgttcccaagggctgctttaagttagcacttcgtttctgctacactaggtattcctgtgagctgaatggtcccgggaactattgataagagtcactgagggacgaaatcaacactctgtgggtatagcactggttgtagaccaccatgctcctgtggaagggtcacctgtaagaatcaaggcagactaccaatagcacctccgttggacagctttcttaggtgtaatgtatgctgtccatgcatctacagacccacagctggatccactgccacccgaagaggttggctcgcccttacaactgcttgtcctctgtgcaaacgatgccccggaaagttagacctatcacccacaccctcccaccacccccaggccaaaaggacagcccacccaagtcccctcccccacagcgaatcgcggtttgttaccaagtacgtatttgacatcaacgattccaactggtggaacgattagatctcgcacactaagtattagcaccctaactcacgaccgagaatcaaaattctgctcagtagacgtctcctttcaggatgacaccattgtccccataggacacggacagaggagggcactggagagagtgtcaggtctttttctagctgtatcttcctctctccctctgctgcccataatgtgagtgaccctctagggtgagacttgcagggtgagctgctgaggaatgaagggccactgagatgtgtcctttagctgctgggtgtcatgtctgacctgctggtgcctagggcctgcttaacactcggcaaggctgcgagccgaggactgtgggaagccggacttgatgctttctaacctgcatatttgaatgccgaaggtcaaacaatccaagttacagataaataaaaaccgcattgcaagtattaaaaagccattctaggaaaattccaattgcccccacccacccccttttttagtacgttatttattattattatttttcctcggcgtcgag

SEQ ID NO: 344 - DNA, 1911 bp, Rattus rattus
gatgttgcaaacagttttcctaactatgctgactctggctctggtcaagtcacaggtcacggaggaaaccattacatacacgcaatgcaccgatggatatgaatgggaccctgtaagacagcagtgcaaagatattgatgagtgtgacattgtaccagatgcttgcaaaggtggaatgaaatgtgtcaaccactatggaggatacctctgccttcctaaaacagcccaaattattgtcaataacgaacagcctcagcaagaaacaccagctgccgaagcatcgtcgggtgctgccactgggaccatagctgccaggagcatggctaccagtggtgtgatccctgggggtggcttcatagccagtgctactgcagttgctggtcctgaagttcagacaggccgaaataacttcgtcattcggaggaacccggctgaccctcagcgcatcccttccaacccttcccaccggatccagtgtgcagcaggctatgaacagagtgagcataatgtgtgccaagacattgatgagtgcacctcagggacccacaattgtagattggaccaagtgtgcatcaatttacgtggttccttcacatgccactgtcttcctgggtatcagaagcgaggcgaacagtgtgtggatatagatgagtgctcagtgcccccatactgccaccaaggatgtgtgaacaccccgggttccttttactgtcagtgcaatcccgggtttcagctggcagcaaacaactacacttgtgtggatataaatgaatgtgatgccagcaaccagtgcgctcagcaatgctacaacattcttggctcattcatctgtcagtgcaaccaaggatatgaactgagcagtgacagactcaactgtgaagacatcgatgaatgcagaacctcaagctacctgtgccagtatcaatgtgtcaatgaacctgggaagttctcatgtatgtgtcctcagggttaccaagtggtgcgaagcagaacctgtcaggatataaatgaatgtgagaccaccaatgaatgccgagaagatgaaatgtgctggaattaccatggtggcttccgctgttacccacaaaacccatgtcaagatccctatgttctaacgtcagaaaaccgatgcgtttgcccggtctcaaacaccatgtgccgagacgtgccccagtctatagtctacaaatacatgaacatccgatctgacaggtccgtgccatcagacatcttccagatacaggcaacaacgatttatgcaaacaccattaatacttttcggattaaatctggaaatgaaaatggagagttctacctacgacaaacaagccctgtgagtgcaatgctggtgcttgtgaagtcgttaacaggaccaagagaacacatcgtgggcctggagatgctgacagtcagtagtatagggaccttccgcacaagctctgtgttaagattgacaataatagtggggccgttttcattttaaacttttattcacataaagcctaccacaggcatttaaatcagccaaagaatatcattacattaaagtttattttatttatagctctatctagtacatctatattcaaacagctagactatggtaggaagtgggcatttaatccataagagtcaacatttatctttatcactgtgtgtaaattagacattagtccaacattcttcttgaagagagctaagcatatattatctagtgaaacttggattctttcctacaaaaatggggccaagcaatgatactgttctgtggtgaatagagaaatatacacctccacaaacaatctcatgaggattggccatctaaacatcaagagcaagaagggttttttttttaacttctttgtaagaaaatggaaaaaagtcaataaagatatatttctttagaaaatg

SEQ ID NO: 345 - DNA, 1548 bp, Rattus rattus
gtcggtggtcgcccgtgctttcgctttctcagggctgtgagggtgttcgttggaattgtcggtccagtcgtcacttgtcctgagggatcacgatgcgccttcctctctccggttacggctcgaagctcgtcctgctctttctgttcctgggagcagttcggtccgatgcattgaaacttaatttgacagattcaaagggtacttgcctttatgcagaatgggagatgaatttcacaataacatatgaagctctaaaagtcaatgaaactgtaaccattacagtgcctgacaaggtgacatacaatggaagcagttgtggcgatgataagaatggtgccaaaataatgatacaatatggatccactctctcttgggctgtgaatttcaccaaggaagcatctcagtattttattaacaacatcacgctttcttacaacactaatgataccaaaacatttcctggtgctgtacctaaaggaatccttactgttatcattcctgtgggatcccagcttccattgggtgtcatctttaagtgcagtagtgttttaactttcaacctgagtcctgttgttcagcactattggggcattcacctgcaagcttttgtccaaaatggtacagtgagtaaacatgaacaagtgtgtaaggaggacaaaactgctaccactgtagcacccatcattcacaccaccgtgccatcgcctactacgacactcactccaacttcaatacccgttccaactccaacggttggaaactacaccatttctaatggcaatgctacctgtctgctggctaccatggggctgcagctgaacatcaccgaggagaaggtgcctttcatttttaacatcaaccctgccacaaccaacttcaccggcagctgtcagccccaaacagctcaacttaggctgaacaacagccaaattaagtatctcgactttatctttgctgtgaaaaatgaaaaacggttctatctgaaggaagtgaatgtcaacatgtatttggctaatggctcagctttccatgtttcaaataacaaccttagcttctgggatgctcctctgggaagttcttatatgtgcaacaaagagcaggtggtttccgtgtctcgaacatttcagataaatacctttaacctgaaggtgcaaccttttaatgtgacgaaaggagagtattctacagctcaagactgcagtgcagatgaagacaacttccttgtgcccatagcggtgggagcagccctgggaggagtacttattctagtgttgctggcttattttattggtctcaagcgccatcatactggatatgagcaattttagcacctacaatctgattgaatatattacaaaatacatacaaataacaaagttgtcttacctgtcagtttatgaaacactttgctacttaagacagactccttggaacttttatttggaaatcagtccccacaatttgagataaggctttttttgaaaaaaaacaaaaaacaacaaaaaaacaaaaaacaaaaaaatcattctctgatctgcttaaaatgca

SEQ ID NO: 346 - DNA, 545 bp, Rattus norvegicus
tttttttttttttttttgagaaaaggtcttcctatggtctcaaactcagggtgatcctcctgcgttggtcttccacatcctgggattacaaaagtgtactaccttgcatagcttccaacatgtttttaaaagtgctctgaaactttcttcaccagaatattttctctgagtgtatgtgagtgaagttatacatatgtacacatgcatacagaagccagaggtcatgaatgtcttcctcagttactctctatcttattttttgagacagggtgtctaactgaatctagagctcacagatgcagcttctggctggccagcaagccccagggatcttgatgtctcctgcttcccagtctggagtggcaggcacacactgcatgtcccgttttttatgacagtgctgcgagtgcaaatccaggtccttgtgcttgggtagcaatcgctccatctactgagcatctctccgacctataaccacactcctgcgctactcacagtctcatggcaaaggcaaagaacaccggatctttccgtcaacacagatt

SEQ ID NO: 347 - DNA, 2812 bp, Rattus rattus
gggatggatccctggatggggccgtctctggatgacctttttctcattctctgctccaaacgttgtctctgtatttccttctgtgaatattttgcagaaccacaatttgaactcctagctaccgacccagcccacgtgcaagacgaaaagggtagaagggagggatcttccggtattaaggtgttaacagtgatgcatcttgggacttgtagttcgcctcaatacgacctgggcggggctccgattgcacgttgggagctgtggagccgtgtggcatgctgggaacgtgaggcgaaaaaggggattgaaaattttcgcccgtgtccccatggatttcgggagactctcgcctatgttacaggagcacttggcacttgaaaaaactcttgtttttgttgtgggaaacacatgaccggggacaaggcaaatttcttgcttccggcgcacccttatcgtcaataggaggcgcccctccgcggcttgttcccggagacttctgggtagcggtttacccccgcccactgcgtcagcatcttcctttcgccgccggacgccgccgaggtcgcacgcgtgaggtctgtccaccgcaaccgagtgagtaccctggccggctggggcgcagatagtggttgggactgagggatggaccgcggccgggagccgagggttgcatattttccgtgatcggaggcctggtgcctcacatggtctcacttgctggttaacaaggagtgggaagcagaaggcctctagggaaacctcaccaccgtaccttccttctctctgtcccattcagcatgcgctacgttgcctcttatctgctggccgccctcgggggcaactccaatcccagcgccaaagacatcaagaaaatactagacagcgtgggcatcgaggcggacgatgaacgactcaacaaggtagcttgctgctcactaggacccactggatccaaatgtctactagtagcggtccttaaatgttaggtccggattttacccttagagaaaatgtataggacctgttgaaaagggtggaaggaggaggcctacacccgtcttagtcatagttttctctttaatccttttgaggaccttgtgcaagtcaaagaaaatccgggcatgacaaaagtcctgctcatcgtgcttttgtagaagtttaatactactcgcttgtgggacttttgagatcaggtttactgtgtagctctgactaacctggaacgcactgtgtaaactagtttccttaactttttcctttttgaaactaacttggcagtaaaggatttacgcccacaagtgagaaacatctggtctccctggatctatagttagggttagctgataaatgtaagtgctgggagtcaaactcttaagatatggtgagtccgagctgtacagtgtgatcttacctggaaaagaacaggtcttcacagaatcttagaattttagtacctaaaacttgccactgccaacatctttgttgagaagacccagtactgtctcacggctagttactggggtagggtacaagtaggacaccttcccgtgtctgtctgtcttgcattactgactgctggttgtggttgtctattccaggtcatcagtgagctgaatggaaagaatattgaggatgtcatcgctcagggtgagttcctgggaagtgaacatgtttgtggtccatcctaatccctgctggtcagcccgtgatctgccaggcttcgcttgtggaccagagcatcctagaaaccctgccagagttgtgcgaggcctttttgtgtgcttgtgccggcagcgcttctgaacacgctggagctggcaatggggtcatttgttgattgctcctaccaggatgtgaaagccttttctgtgagcagggactgggggcactaaaaaattggtgcaggctctttcttaacttttattaggcatacagatttctggtaccaccagactacatcttatttgcaatctgaacagttaactgcacacgagaagcaaaaccagctcagcaactgacctagttagtctgtgaacctcaccccaaaagagctttgggcattgggtcacgctcatggtaaacacgttctcttgatttttagttaactaaaagtttgtgggttttccttttttttatttttttaagattttatataagtacactgtctccatcttcagacacacgagaagagggcatcagatctcatcatagatggttgtaagccaccatatggttgctgggaattgaactcaggacctctggaagagcagtcagtgctcttaaccactgagtcatctctccagcccggaaaacaagtcttaaacagtattaatggtgttcctaagtgtgtgcaaagttgcattgtgttttagagtgaaagcaggtggcagtggtgttccttgtgttggtgagtctacccttacagaacagcctttctggctgggtctctgttctgtctggtctcatgttctttctattttaacataggtgttggcaagctggccagtgtgcctgctggtggggctgtggctgtttctgctgcccctggctctgcagctcctgctgctggttctgcccccgctgcaggtaaatagaggtctgatgagtgggtggtgatcaaagggggggttggtgctcagagtttattttattgttggccggggctcctgggaaaatctggatgcttactatggtgttcctccacagcagaggagaagaaagatgagaagaaagaggagtctgaggagtcggatgacgacatgggatttggcctgtttgattaagatcccctgccaataaagcctttttatgt

SEQ ID NO: 348 - DNA, 3641 bp, Rattus norvegicus
ggatccaatttgatatggttatatccaattataatttgtataagcaccacatatgtattaggtgtttgttgactccactgcaacacaaattgtactagctgtccctgctgctgctgcactcaaacttgttcctaagttagggccttgtgtgcacctaccattgagccacattcctcactccagttagcaaaatttccaaactattatatgccaggcaatggcttaggtaccaagaataaacaatccgtgttctgtctgggtaaggggcaaattaacaataaacgcccaagtactaggcaactgataatacctaacagtgtaacctagggtcacaagagtaagtctcttagtggcactttacaccagagggctgaggaaagcccaacagattgaattgacaaagagaagtcatgtcatttcacactcagagctcatcttctctcctcccgaatgcctttagcttgctctgcttggaaatatccaggtcttcctcacaccatccttcctatccctctacccaagagtctcccttggctccatactatacagttgaaggtgtgaccggtctcactttaaagacaatgcccccacacaacactggtccgcatcacctgccctgactagagagcacttgtgtgtagctgtggctgccctccaccatgttgggaaggccttaggaagtaagcatcacgcagtgactatttctacttatctccaaaggcccgtgttcagatagaaaacccggggtctcaacacatcccacttgagttaaaatctcccgaggatggcaaaggagggggcaggggtatctccgagttcgaaggcagcctggtctagaatgagtcccggggcagccagggctacaaagagaaaacctatctcaaaaactccaatcaaggggttggggatttagctcagcggtagagcgcttgcctagcaagcgcaaggccctgggttcgatccccagctccgaaaaaagaaccaaaaaacaaaaaactccaatcaaatcttctagattgggccgggcgtgacgacgcggtcgaggctagcctggtctacacagtgtgctctaccacggccagagcaaatagtgaggccctatctcaacccccaccagcacctccacaggtaatttttaatcgatattgtcagctgatgagggcacccgtttgctacgcttggaaccagttagtggcaatccgtttaaagcaatccaagacaactctctcgtcctctgccacggagggaactcgtgagcggtcccaggcaggccgagtacttctcccaccacacaccaggaagtcacctctctgaacctggagttatacctaccgcgtgaggtcagagattaaatggactgtttgtgcactgctcacacacacacacacgcgcgcgcgcgcgcgaaattgcttttattaggagctctcaggaaagtggtggctcgcatcaggctaccacagccaagaggaccgccacctctaccgagggcaggccaaggcccactaaacggcccgaatgaactctaggccttccggcgctctccagctcttcagcgcggcgaacgttctaggcccctgagaagtccaccgggaggcgcaggtttccgctacgcgagggggaaatccccgagaaatgcccagaccacctaagcacagacgtccatgcggcgtacggatacctgagggaatccgggccataccgccacctactcgcgcctcactcaagccgcgccaaactcgcgcgtttcactgcgcaggcgtgtacgcagcgggcgctcaggaacactcaaaggaccagcacactgaccaatcaacgtccgccttggccaaaactagtcccgccctcaaaagcagacgtcaggccccgcccctaagagccccgccctcccccacgctttaggcccgacccacgccgtcctgggttaaggctcgcggttggttcgggggacggacgcgagctctggttggtggaggtgaggtcacgagaacaccttcgtcgcctttccagaggcgattactgggcaagctcagtcttttgcctcagacgctagctgtagctggcaggcggttgtacgtgctccagagtcttcattacccgccgatccagtcgtcttcgcgtgggttccgctaagctcttctgagctgctcgctctctacacacgccgtcgccgtaatccgccatcatggtgaaactcgcaaaggtaataggcctgacgcgcgaacacggacgactaggcctgctttctgagagacgcgcgcgcgcccgtcgcggaggggaggagggcctgcgcacagtcccgggcgcgttcgagggcgcatgctgagggaagtctcgcgcgactagcggaagggtctcgcggtgtttggcctctgacttgagggatgagaggagccgaggcaggttctgggagggcgatgtagagtgcaccggggccgggggtcggtgtgaggggaagtcggaggagttgagcgcggagagggggttggaggctcggcgagtgaagtgggccaaccttaagcggctaccgctctcgggggcccccgcctcccggcgcacgtgctccggtgcgcggcccgccacgtggttacggcgctccgcacgtgtcgcgcgtccgaggcagtgaggggagtgggagtacacgggaaagggggacagtagagttgggccatgttacctagcgatcgcatgtccctgaccgtgacggtagatggacacgtggtgggctcctgaggtagcgcgtggtgacccggcctaggtgactccacgtggtttggctgtaagcgtgagaaagtaggaagtagctccgatacagagatgcttttaagaggtgccttcgagataacccccttccccggcaaatagttaaaatggaacctttaactgggtttttttcttttttgtggaaggtgccagaaaataaagtgccacgactaagtagactttaaaaacctgtggctgtttcctggtgaaggtttctgtctgtaagacaaattatgcgcagttctcagaaaaatttgccaggaagagtgtgctgcctggccacgagaagtctttatgcttgtgttctttagtaagaaaggaggtggtggccgaggacaaagtggcttacaatgcgggtgatttttttgtgtgcatttgtaggccggcaaaacccacggagagtccaagaaaatggctcctcctccaaaggaggtggaagaagatagtgaggatgaagaaatgtcagaagatgaagatgacagcagtggagaagaggaggtaggatgctatttgaaaaattgtgtgatttgcagtggtagattgactggaagtgtcagaaataacagtcagttcggggggtgtctgggcagagttttgtatgttgtattgagtagagtttactgtagatttgtggggtggttttccctccgtttttgggaaaattgcttattctagcctaatttttattcagtccatggtcacttggctttgtgaattttggcaggacattatgacaggaagctgtagaccagcctaacctcagataggttctcctgaattaggtgttagccacagtatccacgacaaatgacaagtttagtgagaaacccagactttgatctaggtagagatggaatcagggtctcagcttaggtggtacc

SEQ ID NO: 349 - DNA, 3463 bp, Rattus norvegicus
cggtgaggggagccgggcgggtggcagagcagagcaggaggaagcaacggccacagacgcatcgggaccgcgagtcgtagtcgggggatccgcggggcggaggcgggcaccatgggcaaccgcgggatggaagagctcatcccgctggttaacaagctgcaggacgccttcagctccatcggtcagagctgccacctggacctgccgcagatcgccgtggtgggcggccagagcgccggcaagagttcggtgctcgagaacttcgtgggccgggacttccttccacgaggatcaggaattgtcacccggaggcctctcattctgcagctcatcttttccaaaacagaatatgcggagtttttgcactgcaagtccaaaaagtttacagactttgatgaagtccggcaggagatcgaagcagagactgaccgggtcacaggcaccaacaaaggcatctccccggtgcccatcaaccttcgggtctattcaccacacgtgttgaacttgaccctcatcgacctcccaggcatcactaaggtgccagttggggaccagccaccagacatcgagtaccagatcaaggacatgatcctgcagtttatcagccgggagagcagcctcattcttgccgtcacacctgccaacatggacttggccaactcggatgccctcaagctggccaaggaggtggacccccaaggcttgcggaccattggtgtcatcaccaagctagacctgatggatgaaggcacagatgccagggatgtcctggagaacaagctcctgcccttgagaagaggctacatcggcgtggttaaccgcagccagaaagacatcgagggcagaaaggacatccgggcagctctggcagctgagaggaaattcttcctctcccacccagcctaccggcacatggctgaccgcatgggtaccccacacttgcagaaaacactgaaccagcaactgaccaaccacatccgggagtcactgccaaccctgcgcagcaagctgcagagccaactgctgtccctggagaaggaagtggaagagtacaagaatttccggcctgacgaccccacacgcaagaccaaagccctgctgcagatggtccagcagtttggagtggactttgagaagcgaatcgaaggctctggagatcaagtcgacaccctggagctgtctgggggcgcccgcatcaatcgcatcttccacgagcgctttccctttgagctggtgaagatggagtttgacgagaaagacctccgaagagagatcagctacgccattaagaacatccacggagtcagaactgggctcttcacgccggatttggcgttcgaggccattgtgaaaaagcaggtggtcaagctgaaagagccctgtctgaaatgcgtggacctggttatccaggagctaatcagtacagttaggcaatgcaccagcaagctcagttcctacccccgccttcgagaggagaccgaacgcattgtcaccacctacatcagggagcgagaagggagaaccaaggaccagatccttcttctgattgacattgagcagtcctacatcaacacaaaccatgaagacttcattggatttgccaatgcccagcagaggagcacgcagctgaacaagaagagggccatacctaaccagggggagatcttggtgatccgcaggggctggttgaccatcaacaacatcagcttgatgaaaggcggttccaaggagtactggttcgtgctgactgctgagtcgttgtcttggtacaaggatgaagaggaaaaagaaaagaagtacatgctgccactagacaacctcaaaatacgggatgtggagaagggcttcatgtccaacaagcatgtgtttgccatcttcaacacagagcagaggaacgtctacaaggacctgcgacagatcgaactggcttgtgactcccaggaagatgtggacagctggaaggcttcgttcctgcgagctggggtctacccagagaaggaccaggcagagaacgaggatggagcacaagagaacaccttctccatggacccgcagctggagcggcaggtggagaccatccgcaacttggtggactcctatgtggccatcatcaacaagtccatccgggacctcatgccaaagaccatcatgcacctcatgatcaacaacacaaaggccttcatccaccatgagctgctagcctacctgtactcatcagcagaccagagcagcctcatggaggagtcagctgagcaggctcagcggcgggacgatatgctgcgcatgtaccatgcactcaaggaagcgctcaacatcattggggacatcagcaccagcaccgtgtccacgcctgtgcccccacctgtcgatgatacttggctccagaacaccagcagccacagccccactccacagcgcagacctgtgtccagtgtgcacccgccgggccgcccacccgcagtgcggggccccacaccggggcctcccctcattcctatgcctgtgggggccacatcctccttctcggcaccccccatcccatcccggcctggaccacagaatgtgtttgccaacaatgaccccttctctgcgccacctcagataccgtctcggccagcacggattccccctgggatccctccaggagtgcccagcagaagagcgcccgctgcgcccagccggcccaccattatccgcccagccgagccgtccctgctcgactaggctgcaggggacagtgttctgggggggtcctcgtgtacctacagtggtctgggccctgctactgccccccatgctgggaccaggctccccgtgggcaagcctgccctctcctccctagccctagtgcacatgataaggagggagagggtgggaaggaggcccaaacaaacagaacttgggggctttgcactttggggcgagggggagctctggttagcagaacagaaactgcacccttgggaccatctggaaagaaaggtctaggctagtggtggggaactctacatgggctcctccatactgtaagcctttgctctttctgaggtacagaactgtccacctttccctaaggactcctcaggagttagccaggcccaggaggtccagtgctggccacccacctggctcaagttgtatatatatatatagcttctttggccacattaaccacacagcctgagcccagcccagtctccacacccagaggtgcctttgtgccttccaggcctggagtgcctcagctctggcctgcctctctcctcagcccctgttgtggtttgggctgtaagaactctggagacatcaggacctcttggcttccaaccagatgtctcctacagggtgggccctggtgcctctgtacagattctgctcccaacgcttggattgaccactgttaagtgcctgcctctgtatatcctattaataaactaaaataaagggaagccctctcgtggct

SEQ ID NO: 350 - DNA, 2350 bp, Rattus norvegicus
gtgcccggaagcaagtccaccgccaccatcaacaacattaaaccaggagcagactacaccatcaccctgtatgctgtcactggccgtggggacagtccagccagcagcaagccagtttccatcaattatcaaacagaaattgacaagccatcccagatgcaggtgacggatgtccaggacaacagcatcagtgtcaggtggctgccttcaacttctcctgtgacaggttacagagtgaccaccgctcccaaaaatggcctaggaccaacaaaatctcaaactgtcagtccagatcaaacagaaatgaccattgaaggtttgcaacccaccgtggagtatgtggttagtgtctatgctcagaaccggaacggagaaagccagcccctggttcagactgcagtgaccaccattcctgcgccaaccaatctgaagttcactcaggtgtcacccaccaccttgactgcccagtggacagcgcccagtgttaagctcactggctaccgagtgcgggtgaccccgaaggagaagacaggaccaatgaaagaaatcaacctttctccagacagcacctccgtgattgtgtcagggctcatggtggccaccaagtatgaagtcagcgtctatgctctcaaggacacattgacaagcagaccagctcagggagtcgtcacgactctggagaatgtcagccctccaagaagggcccgtgtgaccgacgctacagaaactaccatcactattagctggagaacgaagacagagacgatcactggcttccaagtcgatgccattccagccaatggccagaccccggttcagaggaccatcagcccggatgtcagaagctatactattacaggtttacagccaggcactgactacaagatccacctgtacacgctcaacgacaatgcccggagctctcctgtggtcattgatgcctccacggccattgatgccccatccaacctgcggttcctgaccaccacacccaactccttgctggtatcatggcaggcaccccgtgccaggattactggctacattatcaagtatgagaagcctggatcccctcccagagaagtggtccctcggccccgccctggtgtcacggaggccaccatcactggtttcccatcaggtctggagccaggaaccgagtacaccatctatgtcatcgcactgaagaacaatcagaagagtgagcccctgattgggaggaaaaagacaggtaaagactcctaaccgaccgttggtttgcagggtgaagttctctacgttttgacacatcgctcctggatttttttttttctagcagaatggcttatatattgtactattaggcacaaatcacctaacatgctctaaaaatgtcttatttatttttctacagccttaagcttcttttaccttgcagaaattcaaattagattgtttgaattggggttgaggtgggggggggctttttaatggtgagagtaaaacctctccgatttgtgttgatttgtttattatttgatttctgaacttcagatatttcagttagttgcaaaggcttaactggagcagagatggctgtctgtggggctcagcggttcaaagctttgtctgtatgagaattcaaactaacattttttcccccatctaaactataaagaaatctgtgaaaagaagaaaaaatccagatttctttctagagtgttctgtgatctgagaaccgctggctgtctgggagcattgatcgggttgatatacagttgttgcctggattgatggtgattggttgcttcttctttgagcttaacgcgctttgcttttttggctctaacctctctcttggctagatgagcttccccaactggttacccttccacaccccaatcttcatggaccagagatcttggatgttccctccacagttcaaaagacccccttcgtcaccaaccctgggtatgacaccgaaaatggtattcagcttcctggcacatcccaccaacaacccagtgttgggcaacaaatgatctttgaggaacatggctttaggcgaaccacgccacccactgcggccacccccgtcaggcttaggccaagaccatacctgccgaatgtagatgaggaggtccaaatcggtcatgttcccaggggagacgtagactaccacctctatcctcatgttccggggctcaatccaaatgcctctacaggacaagaagctctctctcagacaaccatctcttggacgccattccaggagagttctgagtacatcatttcatgccaacctgttggcactgacgaagagcccttacaggtatatattacagcccttattatgagtgtctctctagat

SEQ ID NO: 351 - DNA, 632 bp, Rattus rattus
tccagaatcagaattaagcattaagtgtccaatattataaagctgtttataacaggagttttaagtagtggtaacatttaacccatgtaaaaatgtcaacagaatttaaatcgtgacttggatcctgaacgattcaagtaccatggtctcactcagagacgggtttggtcagttttaagatgaactccttcggatgtagtgtccgtaagtccttattatcgctgtccatcaattcacgataggatagctggctgcggtggcaagtccgcagtggttgttccggtctttggctattttgatgtagccatccataccccattctttaccccagctgtttttgacaagccagtatttatccttatttgaatctgttccttcataaccatagccaaccaccagaaccccatggtcgaggtccttgctgctacagttgggttcatagtagatacctgaactatagaactggagagacggatggcttgcatccatggcaacagaaataggccccaccgtcgctacagccttcatgagggctttctcttgctgagggatatccacaaaccctgtgtcgttagccagtccacagtctccttgtgccgaattcttggcctcgagggccaaattccctatag

SEQ ID NO: 352 - DNA, 1552 bp, Rattus rattus
tcagttctgtaattaattaactaacgtggatcaaatgagaaggtgaaagttcacacaggagcactcctgtcgtcttggactgggtctccatcccaccatccagtgccctggtctacgaagagtccacagggaccttgtgaagaatcaacaaggcggggtccagaggagtcacgtgtgccttccactccgggtcgccctgtcaggatggggatgtcccagcccggggtcctcctcagcctcttattggtcctcctgcctcagacctggggagcggagccccgtctcccactgatgtatcatcttgcagctgtgtctgacttatcaacggggcttccctctttctgggccacgggctggctgggtgctcagcaatatctgacctacaacaacctgcggcaggaggctgacccctgtggggcctggatatgggaaaaccaggtgtcttggtattgggagaaggagaccacggatctgaaaagcaaagaacagctcttcttggaggccatcaggaccctggagaaccaaataaatgggaccttcacactgcagggcctgctgggctgtgaactggcccctgataattcttcattgcccacggctgtgtttgccctcaatggtgaggagttcatgcggttcaacccaagaacgggcaactggagtggggagtggccggagacagatatcgttggtaatctgtggatgaagcaacctgaggcggccaggaaggagagcgagttcctgctaacttcttgtcctgagcggctgctaggccacctggagaggggccgtcagaacctggagtggaaggagccgccatctatgcgcctgaaggcccgtcctggcaactctggctcctcagtactgacctgtgctgctttctccttctacccgccggagctcaagtttcgattcctgcgcaatgggctagcctcaggctctgggaattgcagcactggtcccaatggtgatggatctttccatgcatggtcattgctagaggtcaaacgtggagatgaacaccattaccaatgtcaagtggagcatgaggggctggcccagcctctcactgtggacctagattcgcccgccagatcttctgtgcctgtggtcggaatcattcttggtttattgctggtggtagtggccatcgcagggggtgtgctgctatggaacaggatgcgaagtgggctgccagccccatggctttctctcagtggtgatgactctggcgacctattgcctggtgggaacttgcccccggaggctgaacctcaaggtgtaaatgcctttccggccacttcctgatgccaacccaggccccatacccattgcagcctgtggggctgtgtgacctcctgaactgtctctgagcctcccgagggagccctgggctggatgtcctcctcgtggatcccttcttttgtggcctgcttcagtttcccctcttaatgtcaatggctatttccatctccacataaatttgggcccaaatctgtgtgtgcatcgttattctcaggtttcaggcagccggaataaattgaacaagtttgag

SEQ ID NO: 353 - DNA, 3765 bp, Rattus norvegicus
cctgacactaggagcacggggccgcaggactcggagtccttcgcccacactcggggagtctctggcacctcgcaagggcagcttcagtggcaggctaagcccagcctacagtctgggctctcttactggggcttcacctcgccagagcccccatgctcaaaggaagctttccagtggggacttgcgggtgcccatcccaagggagaggaaaaatagcatcacggagatcagcgacaatgaggacgatctcctggagtaccacaggcggcagcgccaagagcggctccgggagcaggagatggagaaggctggaacgccagcgcctggagaccatcctgaacctgtgtgctgagtacagccgagctgacgggggacctgagactggggaactgcccagtataggagaggccacggcagcactggctttggcaggcaggaggccctcaagaggcttggcaggagccatagtagtgtctggaaggagtggcgaggagtctggaggtgcctcgcagcgcctgtgggagagcatggagcgctctgatgaagagaatctcaaagaggagtgcagcagcacagagagcacccagcaggagcacgaagatgctcctagcacgaagctccaaggagaggtgctggctgtggaagaggagcgggctcaggttctggggcgcgtagagcagctgaaggtccgagtgaaggagctggaacagcagctgcaggaggcagcccgagaggctgaaatggagagagcactgctgcagggggagagggaggcggagcgagcattgctgcagaaggaacaaagagctatggaccagctgcaggagaagttggtggccttggagacaggcatccagaaggagagggacaaggaggcagacgctctagagactgagacaaagctctttgaggacctggagttccagcagctggagcgggagagtcgcgtggaggaggagcgggagttggccggccaagggctgcttcgcagcaaggctgagttgctgcgcagcgtgagcaagagaaaggagcgcctagctgtactggacagtcaggctgggcagatccgggcccaagcagtacaggagtcagagcgtctggcccgggaaaagaatgctgtcctgcagctactgcaaaaggagaaggagaagctgactgtgcttgagaggagatatcattcgctcacgggtggcaggccttttccgaagaccacctcaaccctcaaagaggtttaccgctccaagatgaatggtgacatggccagccccctgcccaggacccgtagtggccctctcccctcctcctcaggctcctcatcctcttcttcacagctcagcgtggctaccctgggccgtagtccttccccaaagagtgccctgctcgcccagaatggcaccagtagtctccctcgaaacctggcagccacgctgcaggacattgagaccaagcgccagctggccctacagcaaaaggtcgagttacctcctgccgagcccctctcacccgaagacccagcagggcaccaagtgatcgaggagcaacggcgacggctggctgagctgaagcagaaagcagcggcagaggctcagtgccagtgggatgccttgcatggtgcagccgcctttccagcaggcccgtctggcttccccacgctcatgcaccattctatcctgcaccacctgccagcaggcagggaacgtggagaggagggcgagcacgcttacgacaccctgagcctggagagttcggacagcatggagaccagcatctctacggggggcaactccgcctgttcccctgacaacatgtccagcgctagtggtctggacatgggcaagatagaggaaatggagaagatgctaaaggaagctcacgcggagaagagccggctcatggagtccagggagcgggagatggagctacggaggcaggccctggaggaggaacgtcggaggcgggagcaagtggagcggaggctgcagagtgagagcgcccgcaggcagcagctggtggagaaagaagtcaagctgagggagaagcagttttcccaggctcgacctctgacacgttatcttcccaaccggaaggaggactttgatttgaagacccacatagagtcgtcaggccatggggtggacacctgcctacatgtggtgcttagcagcaaggtctgccgtggctacttaatcaagatgggtggcaagattaaatcgtggaagaagcgctggtttgtctttgaccggctgaagcgcaccctttcctactatgtggacaaacacgagacgaagctgaagggggtcatctacttccaggccatcgaggaagtgtactatgaccacctgcgcagcgcagccaagagtccgaatccagccctcaccttctgtgtgaagacccatgaccggctgtactacatggtggccccatctgcagaggccatgcgcatctggatggatgtcatcgtcacgggagctgagggctacactcaattcatgaactaactaccaggcacctcctgggtcccccaggtcagccccaggacaccatgccctgccacttgctgctctgcttgtccctggagacagaggcacactgggcacgggccacaaagggtcaggatgtagttgagtaccccagggcttttgtgcaagaaaacgaaattgttctatgaggagtttggtgcttgggaatcaggctccggtccctaaagagccagcagagaggaaaggaagagggagaggccttgtcgcctcctgggagtccagaagtgcaggattccctcctgggtccagcaggctgaagaggcatagctgagctgtgactctcagctctgtcctggtacccacttagcccagcttactttctctctgtaaaggacaaattatggtaccagaatctgccaaagatcccctttctcatctcatcccctctacaggggtctggggggtcctgagcagagccacgtgtagaacaggggagaggctcaggcctgcacttcccgcccccggtctgcctccttctcctcccacctcccacttttcactacttagctcaaggaccagagacctcaagtgtcattctcgaggtccagccccgtaatcatgttacaagcccatcatccttgtctccatggtggctgcttcctcaccatggttacacactaattgccatggccactctgtggctctgcccactgcttcggctgtgggccacatgagggtacatgccacccatctctccaacccaggcctgggggcctgtcacatggtgggaggagatagagttcctcccggctgcagtgtgtctccagcccccagcccagccctctcccttttactgtgccttgcttagagccagaagggatgatgtccagagatccaagaccagagagcagcatcactgaggggagaggaagctaagaggtctgccctcccattctgacaggactagttcccaataaggaacgagggtggtagctcagagtgtctggaaagaagcctgagttgggagcagggcgggcagaagcagaggccctgagctgtggtaacctcccttcagtttcccaaaggtgacgggaaagaaggacagaggatcaagtctccagctggctggcctcagccttgcgccttaacactaagccaccttccctgccctccccagcactgggcccttggttgctgggcctggctgggtgttttgcagtatttgtaagcatttcagcagaacaataaaagcattttgactatgtaaaaaaaaaaaaaaaaaaaa

SEQ ID NO: 354 - DNA, 711 bp, Rattus rattus
caaactttttttttatttttttttttttttttgcgttgaaaatcatttaatgagaattatactttttctctatcagattagatctgttctagtgattattgtctggtgttacaagctcatctgtctcagagttggttagtgtgcatgaagctacttaagaaagatatggacaagcacagctcactggtccccctgagcacctcacaagactgggaacatcctctcaagggttaaaacagacgggcatacgggctgagaatttattttgaaggcaggataaacaggccagctctaagaagatactgttttgaaagctcacacgtttcataagtttctgagttcaggcagtctcagttctcatccactgagtcctgggccctcaaaagccctccaggtccaccacagaggctgttctaactgggtgctgagcctatacaaagccctggcactcacacaactgccattccccaagatcaactcgtctcctgtaaatatgtgctgtttgtatccggcacagggctgatgaagatggatcccgatggagcctactgtgcattacttcctgatgtgcagagatgtgtgtggtgagactgtgcgggatgctgggagcagtgtgcagtgcgttgggagactgagaagtgaaagccctgttggtttgaggggaaagcaaggaaatgtgacctttcccatagctactcccacagtgagaaa

SEQ ID NO: 355 - DNA, 735 bp, Rattus norvegicus
acgcagctttgagtccacacctctgtctacgcagcagctatgccgccgtacaccattgtgtacttcccagttcgagggcgctgtgaggccacgcgcatgctgctggctgaccagggccagagctggaaggaggaggtggttaccatagatgtctggcttcaaggctcgctcaagtccacttgtctgtatgggcagctccccaagtttgaagatggagacctcaccctttaccaatctaatgccatcttgaggcacctgggtcgctctttagggctttatgggaaagaccagaaggaggctgccttggtggatatggtgaatgatggggtggaggaccttcgatgcaaatatggtaccctcatctacactaactatgagaatggtaaggatgactatgtgaaggccctgcctgggcatctgaaaccttttgagaccctgctgtcccagaaccagggaggcaaagctttcattgtgggtaaccagatttcctttgcagattacaacttgctggacctgctgctggtccaccaagtcctggcccctggctgcctggacaacttccccctgctctctgcctatgtggctcgcctcagtgcccgccccaagatcaaggcctttctgtcctcccctgaccatttgaaccgtcccatcaacggcaatggtaaacagtagtggacgaagggacaggaactccttgtcccccttttcccagactaataaagtttgtaaggcaga

SEQ ID NO: 356 - DNA, 631 bp, Rattus rattus
ctgccttacaaactttattagtctgggaaaagggggacaaggagttcctgtcccttcgtccactactgtttaccattgccgttgatgggacggttcaaatggtcaggggaggacagaaaggccttgatcttggggcgggcactgaggcgagccacataggcagagagcagggggaagttgtccaggcagccaggggccaggacttggtggaccagcagcaggtccagcaagttgtaatctgcaaaggaaatctggttacccacaatgaaagctttgcctccctggttctgggacagcagggtctcaaaaggtttcagatgcccaggcagggccttcacatagtcatccttaccattctcatagttagtgtagatgagggtaccatatttgcatcgaaggtcctccaccccatcattcaccatatccaccaaggcagcctccttctggtctttcccataaagccctaaagagcgacccaggtgcctcaagatggcattagattggtaaagggtgaggtctccatcttcaaacttggggagctgcccatacagacaagtggacttgagcgagccttgaagccagacatctatggtaaccacctcctccttccagctctggccctggtcagcca

SEQ ID NO: 357 - DNA, 4945 bp, Rattus norvegicus
ccaaagttgagctttggaacaggccggcttcccctgtttttgtggatttgtaggatagccaatttccccccatctcgactttcaactgctttggacattagcttcataggaagaattcattctttagagtaaaatggagcgccgctttttgccaggggccccagcccctctgtttttaccctgtcagaagttagaatgtcactaaaaagtgaggcccgggtgaacacttctacactgcagaagatcgccgcagatatgagcaacctgatagaaaatctcgacacccgggaacttcattttgagggagaggaggtggagtatgatgcatctccaggagaccccacggctcaggaagcgtgcatcccattctcttctatttacaacactcaaggatttaaggagcccaacatccagatctacctctctggctgtcctgtaaaagcacaagtactggaagtggagcgcttcacgtcgacctcgaggatgccaagtgtcaacctgtacaccatcgagttaacacacggggaattcacatggcaagttaagaggaaattcaagcacttccaagagtttcatagagagctcctcaagtacaaagccttcatccggatccccattcccaccaaaagacatacgtttagaagacaaaatgtcaaagaagagcccagagaaatgcccagtctgccccgttcatcagaaaatgcaatccaggaggagcagttctttggcaggaggaagcaactggaagattacttgacaaaaatactaaaaatgcccatgtacagaaactatcatgccacgacagagttccttgatgtaagccaactgtcttttatccatgatttgggaccaaagggcctggaaggaatgatcatgaaaagatctgggggacacaggataccaggtgtgaattgctgtggccatggaagagcctgctaccggtggtcaaagaggtggttgatagtgaaagactctttcctgctgtatatgaaaccagacagcggggcgatcgccttcgtccttcttgtagacaaagaattcagaatcaaagtgggaaagaaggagacagaaacaaaatatggacttcgaattgataatctttcaaggacactgattttaaaatgtaacagctacagacatgcccggtggtggggaggcgccatcgaggagttcatccagaagcacggcactgacttcctcaaagaccatcgcttcggctcctacgctgcggtccacgagaacattttagctaaatggtacgtgaacgccaaaggttactttgaagatatcgcaaacgcaatggaaggggcaacggaagagatttttatcacagattggtggttaagtccagaaatcttcctgaagcgcccagtggtggaaggcaaccgctggaggctggactgcatcctcaaacggaaagcacaacaaggtgtgcggattttcataatgctttacaaagaggtggagctagccctcgggatcaacagcgagtacaccaagcggactttgatgcggctgcaccccaacataaaggtgatgagacacccagaccatgtgtcctccagtgtgtatctgtgggctcatcacgagaagctcgtcattatcgaccaatcggtggcgtttgtgggtgggattgacctggcctatggacggtgggatgacaatgagcacagactcacagatgtgggcagtgtcaagcgggtcacctcaggacagtctctgggctctctcacggcagcatcagtagagtctatggaatccttaagcctcaaggacaaacatcaatctcataaaaacgagcccgtcttaaagagtgtcgacgataccgacatgaaactgaaaggcatagggaagtccaggaaattctccaaatttagcctctatcgccaacttcaccgccgtaatctgcacaactcggacagcatcagcagcgtcgacagcgcctccagttattttaaccactatagaagtcatcagaatttaatccatgggttaaagccccacttgaaactctttcgcccttccagtgagtctgagcagggcctcactaggcacagtgctgacaccggctccatccgaagtgtgcagacaggagtgggagagctccatggggagactaggttttggcatgggaaggattactgcaactttgtcttcaaggactgggttcaactggacaaaccttttgctgatttcatcgacaggtactccaccccccggatgccttggcatgacattggttctgtggttcacggaaaggcagctcgtgacgtggctcgacacttcatccagcgctggaacttcacaaagattatgaagccaaaatatcgttccctttcttatcctttcctgctcccaaagtctcaagccacagcgcatgagctgaggtatcaggtgccaggggccgtccacgccaaagcgcagttgctccgatctgctgctgactggtctgctggtataaagcaccacgaggaatctatccatgctgcctacacccatgtcatagagaacagcaagcactacatctatattgaaaaccaatttttcataagctgcgctgatgataaagtcgtgttcaacaaggtgggcaatgctatcgcccagagaatcctgaaagcccacagggaaggccagagatatcgagtgtacatcgtgataccactgctgccgggattcgaaggagacatttccacaggcgggggaaatgccctacaggcaataatgcacttcaactacagaaccatgtgcagaggggagagctccatccttgaacagttaaagccagagcttggtaacaagtggataaattacatatcattttgcggtctgagaacacatgcagagctggaaggaaaccttgtcactgagctcatctatgtccacagcaagttgttaattgctgatgataacacggttatcataggttctgccaacatcaatgaccggagcatgctgggaaagcgagacagcgaaatggctgtcatagtgcaggacacagagacagtcccgtcagtgatggatggaaaagaatatcaagctggccgcttcgctcaaggccttcggctggagtgcttcaggcttgtcctgggttatctttctgacccaagtgaggacattcaggatcctgtaagtgacaaattcttcaaggagatttgggtttcaacggcagctcgaaatgctaccatatatgataaggtcttccggtgccttcccaatgacgaagtgcacaatttaatccagttgcgggactttataaacaagcctatattggcaaaagaggaccgccttcgtgccgaggaagaactgaggaagatccgtggcttcttggtgcagttccccttctacttcttatcagaagaaaacctgctgccttccgttggaaccaaggaagccattgtgcccatggaggtttggacttaagataaaccttttgtagttgagggtcttccaacctgaagactacagtatatgctgacttctaaggacttcacagccatagccaggcctgatgtcctcctgtgaactggtgtaaggatgctggacataaacagggcttcatcactcctccgacttgtccttgagaaaagtggctacatcctgttgatagcatatgctcaaataataccaaacatggagacaaattccgtgatatatttcaaaacccattccctttgctaacaagaatctgtctgtaactttgatccgggttgccaaacgttgcctgagcactgctgttcttcgctgatgtccgtttacacgctggggcccaccttgtcatccatacagcactgtttacaagattgcttatcaatgaaagacattggagaagctgccttgagggtcctcaaggatccaggtgatgcctgtacccaacctggtcctgatgtgagcttatttaccacgccaaaacttttctctctgttctttttcagtcactgtagggacagaacaggctttgcctacctacccacactaggcacttcttaacaacaggcaggcattaagtcctaatactgaagaagattccagttcccagagatgctgcccagctgtgtccttgtcatctgataacatttgtaaacatgtgcagcgcatgtcaatacatagcaaccagataagcacagatggagcctccaaggtgtcagtgggaacccagttcagataaaggacaatattcctgacagtctgtctttcttagccactggattgatagaaaaaaagttgattctctccactgtaagtccagtggatgttaatttgtcttccaactgaatcaaaggctttataatgcccttttcctaagaaacatgagtctaacctgatttacccttcagttttccactaggccttcttcaggggaaaaagcaatgattatacaagatctctcctttgcttgtactgtcaactacatagtaacattccaacatagcttccaaagaagcgataattcacattgttccaatgggatatccacattccctttcagatggtattgtgtcctttgtagaccaaatttcagagttccccttgtatcatgggagtgtctgtgggtgcctggaagcctggagcttatgcacgtgagataactatgtgactgtaagcaaaaggggttcactggagtaaaatctcttcaaagctgctcccgacccatgtttttatgaataaatatgctggtttaaaagatgacacaggaccacaaagccagtgatgtggattagtaacagagcagcagtcacatccaaaggaggatgtcacccctgaggaacactgtacaaatgaggtgggatttgtaatcaacaatggaaattaacatgtttttatgaataaataacttatttcttatatggccaaggatgataaaattatttcattctatagttatggtgaataaaacactttatgcagataaagatctgattacatttaaaatagtcaatgtatatgg

SEQ ID NO: 358 - DNA, 706 bp, Rattus norvegicus
gccttgctctttctgttccttctcggccccagctcggtcctcggcatctccttccatctacccgtgaactctcgcaagtgtctccgcgaggagatccacaaagacttgctggttacgggcgcgtacgagatcaccgaccagtctgggggcgctggcggcctgcgcacccacctcaagatcacagattctgctggccatattctgtatgccaaagaggatgcaactaaagggaagtttgcctttaccacagaagactatgacatgtttgaagtatgctttgagagcaagggaacagggcggatacctgaccaactagtgattctagacatgaagcatggagtagaggcgaaaaattatgaagagatcgcaaaagttgagaaactcaaaccactggaggtggagctacggcgcctcgaggacctttcagagtctattgttaacgactttgcctacatgaagaagcgggaagaggagatgagggacaccaacgagtccacaaacacccgcgtcctgtacttcagcatcttttccatgttctgcctcattggactagccacctggcaggtcttctacctgcgtcgcttcttcaaggccaagaagttgatagagtaatgaggctcagtcttctgtcccctggagccagcagaacatcgctgggacgttgcctggcctagcccaaggccaagttactacgtatatcaaggcg

SEQ ID NO: 359 - DNA, 1459 bp, Rattus norvegicus
gcgtgactatgtcccaccactggggatacagcaagagcaacggaccagagaactggcacaaggagttccccattgccaatggagaccgacagtcccctgtggacattgacaccgggactgcccagcatgacccttccctacagcctctgctcatatgttacgataaggttgcttccaagagcattgtcaacaatggccattccttcaacgttgagtttgatgactcccaggactttgcagtgctgaaagagggacccctcagtggctcctacagattgatccagtttcactttcactggggctcatctgatggccagggctctgagcacaccgtgaacaaaaaaaaatatgctgcagagcttcacttggttcactggaacaccaaatatggggattttggaaaagctgtgcagcacccagatggactggctgttttgggtatttttttgaagattggacctgcctcacaaggccttcagaaaatcactgaagcactgcattccattaaaacaaaggggaaacgtgcagcctttgctaactttgatccttgctcccttcttcctggaaacttggactactggacatatcctggctctctgaccactccgcccctgctggaatgtgtgacctggatagtgctcaaggaacccattactgtcagcagtgagcagatgtctcatttccgtaaactgaacttcaattcggagggggaggctgaagaactgatggtggacaactggcgtccagctcagccgctgaagaacagaaagatcaaggcgtcctttaaataaaatgaccctgcagctggggtccaaaaagcacaagtgtggctgcctctctgtagctaagcacagttccgccttggtgattcagatcccgactttgcatctgatattgtaggcctttttacctctcacccattgtgcttactaataaaatgtgaaaaggaagacccaggtgtctcatgtggtggtagcatggtggcaggctggtggttgacttagggcatcctttctcagccacaacaatgcaatgcaaagaacagatatggcctcttgcttctccacagccatagaataatgagtactcaggcctgtttattaaaatgctatttttaaaaccatataaggtagaatgattgtttacaaatccacatcatgagacaaactgaggcaatttaggcaaatcaggtaaaacagtcatagttttatggttattaattagatgaatgttcactattccaagatcttatattaaagaaaaacttttaaaaagcttatatatttgtagcaaagttattcttaaatatgaattatgttgtaacttagtgacttttgatttctagaggtgtaaatgaagatgtaaaaattgatatagttgtgatacagagtatatttcccttcagataacttaccataacctaatggataatgtattttagatatattctctaataaaa

SEQ ID NO: 360 - DNA, 1581 bp, Rattus norvegicus
ggcttcttggggtaagggacatgcagccagagggccttagcttggcctgatcctgctgtcagggaccctgtccccagtaaccataaagatggccggtgtgtggagcctttctctgcccagctgcctcctgtccctgctcctcctcctccagttgtcacgcagctacgcaggacagttcagagtgatagggccagggcatcccatccgggctttagttggggatgaagcagaactgccgtgccgtatatctcctgggaagaatgccacgggcatggaggtggggtggtaccgttctcccttttcaagagtggttcatctgtaccgaaatggcaaggaccaagacgcagagcaagcgcctgaataccggggacgcacagagcttctgaaagagtctatcggcgagggaaaggttgccctcaggatccagaacgtgaggttctcggatgaaggaggctacacatgcttcttcagagaccactcctaccaagaagaagccgccgtggagttgaaagtagaagatcccttctactggatcaaccctggcgtgctggctctcattgcccttgtgcctatgctgctcctgcaggtctctgtaggccttgtattcctcttcctgcagcacagactgagaggaaaactccgtgcagaagtcgagaatctccatcggacttttgatcctcacttcctgagagtgccctgctggaagataacactgtttgttattgtccctgttcttggacccctggttgctttgatcatctgctacaactggctgcaccgaagactggcaggacagtttcttgaagagctaagaaaccccttttgagtgatggtgcgtcttcctggagcgaaggaaagcctggcaggtccttggggatgtctctcactggcctctctgttatggacacattccaatctacatctacagaaacactcgggatcctgagtagaacttgattttcctcccacaactgtctttctttcctcagctccttcctctaaatcttttttgactcctgtcttagtctgcctctagaaaacaccccatgactaaggccagggagtctatcaggagacacctatgtaccagagtaatacaggagtgattctgccaaccaggacacccagcgcttcaacattacgatctacagaacatcagctctgcaaatggtggatatttcttccagagccacagtcttgactgggaagaatatcagtggggagagtaagggggtgagggacagaagaacccacaacatgagggaaagctaaatgagccagggtatgaatatgggagcctgaaccaaaacctggagattaaaaaaaaaagtcaaaagaatactgactggatcagagcaacaccatcttgctttggcagcctggtgggaggaccttgagaagcaagggtcgagaactgggtctgttctctcatttttctcctatcttatttgagtacccactgtttggtttttttgtttttttttttttcttcttcgttttttcaacaattactacttggtggtgtatcagacacaaacaagctaggtgctaattaataataatacaagtttctttgtgcac

SEQ ID NO: 361 - DNA, 2389 bp, Rattus norvegicus
gtctcaggcagaggtccagactcagtggaagcagaggagagagcctgaaacctggcgagcaccatgagcaacaaatgcgatgtgatcgtggtggggggcggcatctcaggtatggcagcagccaaacttttgcatgactgtggcctcagtgtggtggttctggaagcacgagactgtgtgggaggcaggacttacacaattaggaataaaaatgttaaatatgtggaccttggaggatcttatgttgggccgacccagaatcgtatcttacgattggccaaagagctaggattggagacctataaagtgaatgaagttgagcggctgatccactttgtaaagggaaaatcatatgccttcaggggcccattcccaccagtgtggaatccaatcacttacctagattataacaacctctggagaacaatggatgagatgggccaagagattcccagtgatgctccatggaaggcaccccttgctgaagagtgggactacatgacaatgaaagagttgctagataagatctgctggaccaactctacaaagcagattgccacactctttgtgaacctatgtgtaactgcggagacccatgaggtttctgcactgtggttcctgtggtatgtgaagcagtgtgggggtacaaccagaatcatatcaacaaccaatggaggacaggagaggaaatttattggtggatctggtcaagtgagtgagcggataaaggatatccttggggacagagtgaagctggagaggccggtgatccacattgaccagacaggagaaaatgttgttgtgaaaaccctaaaccatgaaatatatgaggctaaatatgtgattagtgccatcccacctgttttgggcatgaagattcaccatagtcctcctctgcccattctaagaaaccagctgattactcgtgtgcctttgggttcagttattaagtgcatggtttattataaagaacccttctggaggaaaaaggatttctgtggaaccatggttattgaaggagaggaagctccaattgcgtacacattggatgataccaagccagatgcaggctgtgctgctataatgggatttatccttgctcacaaagctagaaaactggtacgccttactaaagaagaaagactgaggaagctctgtgagctatacgcgaaagttctgaactctcaagaagctctgcagccagtccattatgaagagaagaactggtgtgaggagcagtactccgggggctgctacacagcctacttccctcctggcatcttgacccagtatggaagggttctacgccagccagtgggcaagattttctttgcaggcaccgagacagcttcacattggagtggctacatggagggggctgtagaggctggagagagagctgccagagagattcttcatgccattgggaagattccagaggatgaaatttggcagccagaaccagaatctgtggatgtcccagcaagacccattaccaacaccttcctggagagacacttgccttctgtaccaggtctactaaagctgcttggattgaccaccatcttgtcagcaacagctcttggtttcctggcccacaaaaagggtctgtttgtacgtttctaaagatgggctttaggaccatatccacaggtttctcattcagtgtgtcacaaaagcttttggaaggagttgggataaaaatctgacaaaggtgcagagattatggagtgagaaagcacagtaacttggtctccattttggctatcttttagcatcgctgtggtccactcattttcaactttcctgcactctgaatattgagaacagatacacaggctctctcacaacctacctgccctatgcacatagttgtttttcaaaaccctatgcctttgtgcttgtctttcttctggtgtgttaggtcctcacctatatcaagttcttcatcattgtacctagaatcctgtcttgttagaaccagaaggcattagacactgtagcttattgtctactttagagttaaataaaccaaatgcaacagaagtgaaatctaaccacacaaggcctacacaaagctactggtatttgggtgactggaacacaagctgatgcttttctcacctcccaaggttcattcccctgtgatcctcctccaccttatgtcatagtcattcacggatcattgttcttgtggatttactctgtattaactggtattgtgttactcagtagattcttctaggcttgctattttgtgtagtgttgccagctgattctaatttttcttgagaatgggagtcttgtctttgtcatttcttttttgcatcttccagtatgcttccactcatagatttaagacatgcttaaataattaaaaataaagctg

SEQ ID NO: 362 - DNA, 4507 bp, Rattus norvegicus
cctgtagcaggtgctcattcccgggagcagcgcggactgcagccgcctctgcggggaaagatgctgcgggagcggaccgtacggctgcaatacgggagccgcgtggaggcggtgtacgtgctgggcacgcagctctggaccgatgtctacagtgcagcgcctgctggggccaaaaccttcagcctgaagcactcggagggtgtgaaagtagaggtcgtgcgcgatggagaggcagaggaggtagtcaccaacggcaagcagcgttgggccctgtcacccagcaccacactgcgactcagcatggcccaggccagcaccgaggccagcagcgacaaggtcaccgtcaactactatgaagaggatggcagtgcccctattgaccaggctgggctcttcctcactgccattgagatctcactggatgtggacgcagaccgggacggagaagtggagaagaataatcctaagaaggcatcctggacctggggtcctgagggccagggggccatcctgctggtgaactgtgaccgagacacaccctggttgcccaaggaggactgcagtgatgaaaaggtctacagcaaacaagaccttcaggacatgtctcagatgatcctgaggaccaaaggccctgaccgcctgcccgccgggtatgaaatagtcctctacatttctatgtcggactcggacaaagtgggcgtgttctacgtggagaacccgttctttggccagcgctacatccacatcctgggccggcagaagctctaccacgtggtgaagtacaccggtggctctgcagagttgctgttcttcgtggaaggcctccgtttcccagacgagagtttctcaggcctggtttccatccacgtcagtctgctggagtatatggccgaggacatcccattgacacccatcttcacagacaccgtgacgttccggattgccccatggattatgacacccaacatcctgcctcccgtgtcagtgtttgtgtgctgcatgaaggacaattacctgttcctgaaagaggtgaagaacctggtggagaaaaccaactgcgagctgaaagtttgtttccagtacatgaatcgtggcgaccgctggatccaggatgaaattgagtttggctacattgaggcacctcacaaaggcttcccagtagtgctggactcccctcgagatggaaacctgaaggacttccccattaagcaactcctgggcccagatttcggctatgtgacccgggagcccctctttgagactgtcaccagccttgactccttcgggaatctggaggtcagtcccccagtgaccgtgaatggcaaggcatacccgcttggccggatcctcatcgggagcagtttccctctgtctggaggcaggaggatgaccaaggtggtgcgtgacttcctgcaggcccagcaggtgcaggcgcccgtggaactctactcggattggctgactgtgggccacgtcgatgagttcatgaccttcgtccccatcccaggcaaaaaggaatttcggctgctcatggccagcacctcagcctgctaccagctcttcagagaaaagcagaaggaaggccacggggaggccattatgttcaagggtctggggggcatgagcagcaaacgaatcaccatcaataagatcctgtccaatgagagcctcacgcaggaaaaccagtactttcagcgctgtctggattggaaccgtgacatccttaagaaggagctggctctgactgagaaggacatcattgacctgcctgctctcttcaagatggatgaagaccgtcaggccagggctttcttccctaacatggtgaacatgatcgtgctagacaaggacctgggtatccccaagcctttcgggccccaggtcgaggaggagtgctgcctggagacacatgttcgaggcctgctggagcccctgggccttgcctgcaccttcattgatgacatctctgcataccacaagtttctgggagaggttcactgtggcaccaacgtgcgcaggaagcccttcaccttcaagtggtggcacatggtgccctgactgccaggggccctggccttccttccttccctgcgatctccaggtccttcctgtgtccccaagtccttcccctacaagaagcgggtgggattgggattgtgccttgctgtcccctggagaaggactttagtgtccattgaagccaccccgagtaagtccaaccgttccctacccctgaaaatagctagacatgtggttagtgtgcagaactttggaagggaaaaccagacttcaacaaatcatgtagtcgcactgtcccccaaagaattctcagcctctactccagatcagaaggaggggagagagaagggagactctgaggtcattggctcgcccagcacccatctgacattcaagatagaccaggaggaccagggccagggtcctggcgtacctcggatggtaccatcttttcaagcttacctaccttggggcctcctggtcggatccttcgcccattcattccttaaggcttcccatacacactgtgtccccaccccacccccaccccctgagggtccaatcattcagcttagaatcatccggaaatgggtcttagcagaggagaggtcttcactttctgtggattcgggctgcccaattttgggaggacggggaggtctcggactagcatccgatgtccaaagttcagtagacaaagatgcacctgtgtatcgacactatttctgttctctcccccggtcctcagttctctggccagtccgtgagcctctctttccattgttcttctgtttctgacactggccttcctattctggatgttgcccctccagcagctacagtttcttcaccaccagccagattcaggcctcccgagggcctgagaagtagccaatcccactgtccaaggatgctgaggatgctggcaatgccccagcctcactgatcacttcccggctagctactgctccagaggcagaattttccagcacactttccgaaggccttccatccagatacaggcaaatggatcccccctcccccaacctgcttcatttagaaaggcctccaggagctgtagagatggctcggcagttaaaaatgctccctgctcttcaaggggacccaagttcagttcccaacacccacggtgctctgtaactccagatccagaggatccaatacccttttctggtctctgagggcacttcacgcatgtgcacaaacccatagacataaatcaatgtttgagagtctggagagatggcccagtggttaaaagcacttgctgctcttgcggaggacctgggttcagttctcagcacccagttggtggctcacaaccaactataactctagtcccagggggtccgatgctctcctctgacctccataggcttctgcacacaggtggttcacatacacaccctcaagcacacatacaagtaaagtaaagtaaacgatgcttaaaaaatagaaacaaggaaaatatgtctcttaaaatagagaaggtccttttaaggccaagaaggtaggaaatggtaattctgctttggagggttaaacggtcccattttatagctgaagaaaagggttacacccacattcttaggggaacaagatttttaccttgcattatttcctcagtaggttgtatgctactgagtagtgggcacagacttggacgctgataacacaagctagccatagactcgcttgtcccaacagacaaaacccacgtctgcatagccaccctccgcccttgctgtggtaacactacccagtatattcaagaagcattcaggacaacagtcactgccttcaacaattaggaggtgtcctcttttctgtccagctggcctaatgcaccatgccaggtcaggccccagagcctccaaagctgtcatcctctgtctctggggacagaggttcctgcccttgagggcaaagccccaaatcctgtctcctgctccagagtggaaaacacaggcacctctctgagggaggtggtctggggatgtggcggtttgtcgtgtgtggtgttccgttaaagtggcttttactgcttttatttttatctgcgttaagaggaagtgagccctccccacgtggaggccacgacgtgtcttttgtaggttgtgttggtgtttggggaatttctggaactccaggactccgcctgtcccatctcacttactcacccagtgtgaccccctcaagtgtggacgccccatcccgaggactccttgctcttctccacctccattgtttgttggtgttttttttttttaaacttatgcccagaggcttctgggctatgccagttcctgtttcaatgttaattttgaaatgctctgctgagggtgggggtaacggcaggaagatggcgggaatggggcagtatgaacttcctggaaaaaaagccaagatggagtctgaggagtgtctgggggaagagccaaaataaagagcaataaaataagccgtc

SEQ ID NO: 363 - DNA, 1475 bp, Rattus norvegicus
tgcccaaacaccagcacactaggggttcttcacgatctctatccagagcaaacaggcgaaccgagggttaaggggcggggcctcttcgaggggcggggcctcgggcggagcggggtcgggcttcgcgcacctgtaggttctgtctagggatccgctgtcgcagccccggagcagcgccgggagcgcgtcccgagcgtcgtaggctcgcgatcgctatggcggagttcccgtcgaaagtgagcaccaggaccagcagccccgcgcagggcgtgggagcatctgtgtctgcgatgcgaccggacctgggctttgtgcgctccgcccttggggtgctcgcgcttctgcagctggtgctggggctgctggtgtgggccttgattgctgacaccccataccacctgtatcctgcctacggctgggttatgtttgtagctgtcttcctctggctggtaacaattgtcttcttcatcatctacctgtttcaactgcacatgaagttgtatatggtgccctggccgttggtgttactggtcttctttgttgctgccaccgtcctctatatcaccgcctttgtcgcctgtgcggcggcggtcgatctgacatccctgaggggctcccgaccgtacaaccagcgctcggctgcctctttctttgcttgtctggtgatgattgcctacggactgagtgctttcttcagcttccaggcctggcgaggagtgggcagcaacgcggccacgagtcagatggctgggggctactcttaagccagctatgctgtgacctaagccacggctgggtcttagcacagggccacccccaaccttaccaggcttaagctctccaagcactcctgaggaacaggcccaagctggcacagatggacagccaagagccaggagcggggacatcctcctcacctcccttattcagcagaagatgatggggttggggggctcttgtggctttgccttgtcatcagagaacttcagtgtcccaggctgggccaccctgctcaccagcactaaatgcactaacagaccttcagcctctgatctgcctagtgtaaacctaacaagacaacacatgatctacgttccagaagctaagcccacccccaggctcttctggacccacctccccctcccctaccgcacgccaacccattgtcacctgtagagagacttttatagaagagttgggatttcgaggactggactatttcagttggtttcaatagtttccaagacagcaagcctcaccatgtcccctccctcacgtggaactctttctctcctttgggagagagcatccgtgcagggtgctccccccaggctgctgattagacacaggggacttccaaggagggagagagggaagcagggccttgcctggtgagttgtcaggaggttaatggcgactcttatttggaattattattttttacaatttaaataaaaatggatgtgtctgtttgg

SEQ ID NO: 364 - DNA, 3189 bp, Rattus norvegicus
ttcagaatcactacttgaagcttcagatcccttctctacaatgaacctcagcactgcaaaccaccacatacccctaaatgatggtaacagcattccgatcatcgggcttggaacctactcagaccctagaccggtacctggcaagacctttatagcagtgaagacagctattgacgaggggtaccggcatattgatggggcctacgtctaccgaaatgaacatgaagtcggtgaggccatcagagaaaaggtggcagaagggaaggtaaagagggaagagattttctactgtggaaagttatggagtacagaccatgatccagagatggtccgcccagccctggaaaggaccctgcagaccctcaagctagattacatagacctttatatcattgagatgcccatggcctttaagcctggagaggaattttatcctaaagatgagaatggccgagtgatataccacaaatcaaatctgtgtgccacgtgggaggcactggaagcttgcaaagacgctggcttggtgaaatcccttggggtgtctaattttaaccgcaggcagctggaggtcatcttgaacaagccaggactcaagtacaagcctgtcaccaaccaggtggagtgccacccgtatttcacccagacaaaactccttgaagtttctgccagcagcatgacatcgttcattgtcgcatacagccccttagggacctgtcgcaacccgttatgggtgaatgtatcttctccacccttgttaaaggatgaactcctaacctcgctggggaaaaagtacaataagacacaagctcaaattgtgttgcgtttcgacatccagcgagggttggttgtcatccctaaaagtactacccctgaaaggatcaaagaaaactttcagatctttgacttctctctcaccaaagaagaaatgaaggacattgaagccttgaataaaaacgtgcgctttgtggagatgctcatgtggagtgatcatcctgaatacccatttcatgacgaatactgaacatggaaatttcttcagtggagttttttttttgtctttcattcgggatcttgagctgattaatcccctccagtcgtagaaataaatggggtcttgctatcttcagattaagttgagcagaatacaccatgcttaacttgtgtatagtattaattcaacttagctctgatgaagagaagatttaaatatatctaaatagtttgttggaaaatgctttactagtatctttagctcaatgtgttctagattgttgatggaaattaccgaactttaattcaaaaataacaaaatatataaaatacaagatacaatataaaatataaaatacaaaaatataaaaacaggttctaacccaggagtctgagactaccatagggagtttgatttgtttagcatttagcaggacaacaaaagaggttggcatgcttccaggtgctgaccataaccatgacccaaacaaggtcatggacacaagatggacacagccaagacacaaatccacataccaatattaatgcaccttgagtatagacagaactgaaagtctagaaagtctaaagaagaacataaagcaggatgtcccggggctagaggttctcactggaggacttgcctggcagactggagacccagggtgagggtgtgggtgaggactatcagcaaagccataacgattctgtttttaccctttgtttccatccagtgtgcccattcagcttttaatgtgcttgaaggacagacagttaccgattccttcttaaattgtttttgttcagggcagtggggaattgagacagggtctcaggtagtctgctcatgtagctgcttacaaacttgctgtgcagctgagaccagttttgaattctgaacccctggtctctcttccatttttcatggcctgagcttccacctgactggtaagtccccacttgtactgtgctgtaatcattcttgcccacttcatcaaggaaaccaccatgtaaagtggcaagaaacaatcaatatatacaaccaagatttgtatacaatatggtctgaagatggtgatttttaaaagaatgatatttaaatagccatttctttctttctttctgaatctttaaaaattattttatttatgtgcattggtgttagctgcatgtgtatctatgaggaattgtttgaactcatggaactggagttacagacagtggtgagctgtaggtaggtgctgggaattgaacccaagtcattgggaagagctgcaagtgctcttaactgctgagccatctccccagcccccaaatgaatttgggaaatactagaagataaagctttgtaaagtagtttttaagatcttaagaatatttgaggtacgtatctgaattttgacaaagctgcaagttcttttttttaaattggatttttaaaaatttatttacatttcaaatgttatcccctctcctgggttcccatccacagacctccctatctcatcccccctctcccttcttctatgagagtgttcacccacctacccactccttccctcctccctgccctgacattcccctacactagggggtcgagtcttggcaggaccaagggcctctcctcccattggtgcccaacaaggccatcctctgctacataggcagctggagccatgggtctgtccatgtgtctctctggatggtggtttagtccctgggagctctggttggttggttctgttgttatggggttgcaaacccttcagctcctttaatcctttctctaattcctccattggggaccctgttctcagttctatggttggctgtgagcatccacctgtgtatttgtcatgctctggcagagcctctcaggagaatcaggctcctgtcagcagagcacaagtaattttagcgtatataaatttttaaaaagtgataaatgattacaactgtatctatttttaattcatctgaaatacagtacatttgtttatattagatcacttccaaagggtgagagatctctaatatatttaattcatagagaatcaatggccgaagagaataagttttgagaattatcacttaaaaatgtgatcaacatgaaccatttttgttcaatactgttcaatattgttaacaatgctgttctctggaaaatattttattcacatgaattaataaaatataatg

SEQ ID NO: 365 - DNA, 579 bp, Rattus norvegicus
tttttttttttttttttaattgttaattctaacttttattcttatacaatttgcagaatagagttgaaatgattgctgtagttaatgttgataagagctggactataatacaacagaagtgcagtggtgagctgagcaagaacatctgaaaatgaagtcggacatgatttctctatacattttttttgtttgaagaaaattataatagtccgcaagcagtcacagatgaaagaacaaataaaataggtggactgaatagttaagatgaggaacaaaaatatctgtttagagttaaaaatggacagagtgttttattttgcagcaagaagagaaacggatggtggatggcaacagatggacgggagagcgctcagcagcatttgctcttccagcccgtcacacctcctccactgctgatatccacgttttcactgttgggttcttttacaggggtctttcggaggatgtcttcagctaatgtgaggaacgccttttcgatgtttatatttgcttttgcactagtctcaaaaaacctaaatacatgctcccttgcaatctgctctcctttgcctttcggta

SEQ ID NO: 366 - DNA, 2175 bp, Rattus norvegicus
attgcagcctgcggagtgaagcgcgccatgtatgctctcgctctcctcgccagccttctggtcaccgctctgaccagccctgtccaggacccgaagatatgctctgggggctcagcagtagtgtgcagagatgtgaagacggcggtggactgtagggctgtgaagcactgccagcagatggtctggagcaagcccacagcaaaatcccttccttgtgacatatgcaaaacggttgtcaccgaagctgggaacttgctgaaagataatgctactgaggaggagatcctccattacctggagaagacctgtgcgtggattcatgactccagcctgtcagcctcttgcaaggaggtggttgactcttacctgcctgtcatcctggacatgattaagggggagatgagcaaccccggggaagtgtgctctgcgctcaacctctgccagtcccttcaggagtacttggccgagcaaaaccagagacagctggagtccaacaagatcccggaggtggacctggcccgcgtggttgcccccttcatgtccaacatccctctcctgctgtaccctcaggatcggcctcgcagccagccgcagcccaaggctaacgaggacgtctgccaggactgtatgaagttggtgactgacatccagactgctgtgaggaccaactccagctttgtccagggcttggtggaccacgtcaaggaggattgtgaccgcctcgggccaggcgtgtctgacatatgcaagaactatgttgaccagtattctgaggtcgccgtccagatgatgatgcacatgcaacccaaggaaatctgtgtgatggttggcttctgtgatgaggtcaagagagtgccaatgaggactctggtccccgccactgaggccatcaagaatatcctccctgccctggagctgacggacccctatgagcaggatgtgatccaggcccaaaatgtgattttctgccaagtttgtcagcttgtgatgcgcaagttgtctgaactgattatcaacaatgccactgaggaacttctaattaaaggtttgagtaaagcctgctccctgctccctgctcctgcttcaaccaagtgccaggaagtgctggtaacatttggcccctccctgttggacgtcctcatgcatgaggtgaacccgaactttctgtgcggtgtgatcagcctctgttctgccaacccgaatttggtggggacccttgaacaacctgcagcagccattgtatctgcactgcccaaagagcctgcaccgccaaaacagcctgaagagcccaagcagtctgcattgcgcgcccatgtgcctcctcagaagaacggggggttctgtgaggtgtgcaagaagctggtcatctatttggaacataacctggagaaaaacagcaccaaggaggagatcctggctgcacttgagaagggctgcagcttcctgccagacccttaccagaagcagtgtgatgaatttgtggctgagtatgagcccttactgctggaaatccttgtggaggtgatggatccttcctttgtgtgctcgaaaattggagtctgcccttctgcctataagctgctgctgggaaccgagaagtgtgtctggggcccaggctactggtgtcagaacagtgagactgctgcccgatgcaatgctgtcgatcattgcaaacgccatgtgtggaactagctttccagcttgcagaagtcgcctacttgtgggtctagggtaatgaacacatagatctatttgacttaataagtaggagcccccttttgtcttcccccatctcctgtcccttactatagcatttctgtcacgtaagaggcgctgacagcacttccgtgtcccatttctgctccaaggatgaggacacttgggcttcagctccccggctgcccttttcacccacctgctggaggggggtggtgagccagagggcaggagcatgtgctcagccctctcggtgtgtagggatcatggccatctcctagcgtcagggaactgcgcaacttcctgtgctaccaaggagtttaatttggatgcttagaagcacagagtgatcaggcctttagagtgtgggatggccattgccacagcacagagacttgagaagcacctgctgcaggtggcttgctgtgacgttgccgtccctggtcagccttcattctg

SEQ ID NO: 367 - DNA, 1699 bp, Rattus norvegicus
gaattcggcacgaggtattttttctctcttcacttctccttttacacaaatagacatagacttctgggttaccagactgtgctcgccactttaaagataataagcaaattctacctgaagtactgagggacactgccttctaaagggcatactatcccagcatgggcatgagcagcctgaaattgctgaaatatgttctgtttttctttaactttcttttttgggtctgtggctgttgcattttgggctttgggatccaccttctggtccagaatacctatggaatactcttccgtaatctccccttcctgacacttggcaatgttctggtcattgtgggctccattatcatggtagttgccttcttgggctgcatgggatcaatcaaggagaataagtgcctgcttatgtcgttctttgttctgctgctgcttattctccttgctgaggtgaccttagccatcctgctctttgtgtatgaaaaaaagatcaacacgttagtggcagagggcctgaatgacagcatccaacattatcactctgacaacagcaccaggatggcatgggacttcatccagtcacaactgcagtgttgtggtgtaaatggctcaagtgattggatcagtggtccaccatcttcctgcccatcaggtgcagatgttcagggttgttataaaaaagggcaggcgtggtttcactccaatttcttgtatattggaatcgttaccatctgcgtatgtgtgatacaggtgctggggatgtcctttgctctgacactgaactgccagattgacaaaaccagccaggctttagggctgtgatttacacctaccttctgcttaagtgatttatttctctctagaaagtcaaagcacccattccataaggagttaaacaattacgtgcctcactggcattttgactttctcttattccttctttgactggacctctgtcttatacacatccagggaagagaacatttgtcatggacttcccacatcaagcagaagacaaacattaaccaactgatagcagtaaccatatcccttaaagatgatgaaacatacctgggtaattttttaaaagagacactgtagcactgtaatttgatatccactgctagctgcaggtgtgatatatctcagaatactggcctaccacatgtaatccattgagtttagccccaaatccaataaaaagaggtccaagtttaaatgttagactcttaacaattgtaaaatcaatctctaccttctaaatcttgctgctgtcactctacaaagtcacataggagacaagctgaaggaaaatttggagtcccattcattagataattgacatgtccagttcccttttgaacacagtccttgggaataggaatcatacagagatcttttatcactggaaaaacattctgatttctttgttaaaatgtattattgattttgttacatcatccacacatccatccatccatccatccatccatccatccatccatccataaaagactaattattctcatcctaccatcagccagtttgcagctttgaattacattgccaaagaacaactcagaagaattaatatctccagtgtgttagctgataatcatatccatgttgatgttgttgttatttctctattaaataaggttctgttaatgtaccattttaacctgtctcgtgccgaattc

SEQ ID NO: 368 - DNA, 3741 bp, Rattus norvegicus
acacgggtcgttgctttggtgtctgtcacttctgtcgccacctcctctgccaacaccaacactgacctccgtcatgaaccccgacctgcgcaaggagcgggcctccgccaccttcaatccggagttgatcacgcacatcttggatggcagtccggagaatacccggcgccgtcgagaaattgagaacttgattctgaacgacccagacttccagcatgaggactataacttcctcactcgaagccagcgttatgaggtggctgttaagaagagtgccaccatggtgaagaagatgagggaatatggcatctcggaccctgaagaaatcatgtggtttaaaaaactatatttggccaattttgtggaacctgttggcctcaattactccatgtttattcctaccttgctgaatcagggcaccactgctcagcaggagaaatggatgcgcccgtcccaagaactccagataattggcacctacgcccagacggagatgggccacggaactcatcttcgaggcttggaaaccactgccacatatgaccccaagacccaagagttcattctcaacagccctactgtgacttccattaagtggtggcctgggggacttgggaaaacttccaatcacgcaatagttctggctcagctcatcactcaaggagagtgctacgggttacatgcctttgttgtccctatccgtgaaattgggacccacaagcccttgccaggcatcactgtcggggatatcggtcccaaatttggttatgaagagatggataacggctacctgaagatggacaattaccgtattcccagagagaacatgctgatgaaatacgcccaggtgaagcctgatggcacatatgtaaagcctttgagtaacaagctgacgtatgggaccatggtttttgtgaggtccttcctcgtgggaaatgcagctcagagtctgtccaaggcttgcacaatcgccatacgatacagcgctgtgaggcgccagtctgaaatcaagcaaagcgaaccagaaccacagattttggattttcaaacccagcagtataaactcttcccgctcctggccactgcctatgccttccacttcgtaggaaggtacatgaaggagacctaccttcgaattaatgagagcattggccaaggggacctgagtgaactgcctgagcttcacgccctcactgctgggctgaaggcttttactacttggacagccaatgctggcatcgaagaatgtcgaatggcctgcggcgggcacggctattctcacagcagtgggattccaaatatttacgtcacttttaccccggcctgcaccttcgagggagagaacactgttatgatgctgcagacagccaggttcttgatgaaaatctatgaccaggtgcggtcggggaagttggtgggtggtatggtgtcatacctgaatgacctgccgagtcagcggatccagccacagcaggtggcagtctggccaactatggtggacatcaacagcctggagggcctgacagaagcctacaagcttcgtgcagccagattggtagaaatcgctgcaaaaaaccttcagactcacgtgagtcacaggaagagcaaggaagtagcatggaacctaacctctgtcgaccttgttcgggcaagtgaggcgcattgccactacgtggtcgttaaggtcttctcagacaaactccccaagattcaagacaaagccgtccaagctgtgctgaggaacctgtgtctcttgtattctctctatgggatcagccagaaaggaggggactttcttgaggggagcatcatcacaggggctcagctgtcacaagtaaacgctcggatcctggagctgctcaccctgatccgccccaatgctgttgctctggtggatgcctttgactttaaggacatgacacttggctctgttcttggccgctatgatggaaatgtgtatgaaaacttgtttgagtgggccaagaaatccccactgaacaaaacagaggtccatgaatcttaccacaagcacttgaagcccctgcagtccaagctttgaagtttccctgggacacgtctgagctccacaagcagcagaaactctctcctctactcactaatccttgtgaaatcgtcatcaaatttgtgtagctacagagcaaatgatgggtttcttttcctccctataagtaaagagaaatgaacagactttagagattaaatgagaaattcggtgttgtaagtgcagtaatgcagacagagacgtaggaactcagaaagcttcagagctgtggtctgacttgcatttgtactgctgctaatctcagtaggccttgactctggagaattaacagagttttaactacaaatacttacttattttcacatttttactgctaatcactggatatatgttttttaaacaaaagtgttatatagagtggaattttccaggcattcgtgcctaccactttctgatctactgctaagagcaggagtttgggggccagaaactaatagaaaccttgatgtgggtgtgtggctgtcacacaggccgctgctgcctgccatgtgggtgtgtcacccctattaactgtcacattaacatagtcaacaagaggactccttcaacacccacccaccaagaaaccagagttcccgatgggcacaagcacccactccaggctcagccttcgtggtagtggcactactgtgcctttgaccccactttttgacacagttaagttacttgtcttacctccaggctttcagccattgcctggatttcagtcatggtggctgaccttccctttcttgcttgccttccttctcctgaaagagataaaagagatagtagtcagcctctcctcatagattaagtatatggagagccctcagctatggtattactgtattttggtgactttgttaagtaaatttcctgggacaatcctgatttgaaagattctgtattctgttgcacaagctattaaaatgctcagtggtcaccaaagtatttcacacacacacactcacaaatcactcaggtcaccttttacactagaaataacaggaaagccctggccacagccatctgctgagagtgttagttgagatgtttcgttgaagatggctgaagaaagtgcaggccctggggagtttctccttgctgagagccggctctgtggtgagcccctagcagccttacgaggcggtgaaacggccccttcagatgggagcagcctctacaatcattctgagcttaaaggtgaaatatgcaccttttgtcctataaatgtcctataaatgcttggggggaggggtaatgttttgttttttttttcttgaaacagagcccagaatggccttgaactctgatcctcacagcctggtaaatgctgggcctacaggtgtgcgccgacatgtctggctgatcggagctctttattcttaaaagcacagtagggagatgattgtaacattaagtctgtgtctgtggcattcgcattgtgagagcagttccttagaacagttctgagagcacagcatcaatgtagtgaaaacgatgtcgacgcctgacatgaaatcacaaccctccgggtcatcgacacaagccttaacctttctcctggaatgactggtaatcccttaagattgacagtacacagcatgtcaccttgttggggtttctattgacagtaattcatattctggaaaggaactaataaatataaatgaccg

SEQ ID NO: 369 - DNA, 2399 bp, Rattus norvegicus
cgggtcatccgcctggttctgcaatgggcagccatgtatggtgatcttctccaagaagacgacgtggccatggctttcctggaggagttctatgtgtctgtatcagatgatgcacggatgatggtcgccttcaaggagcagctggctgagctggagaagactgtcaaacagatctcagaagacgcaaaagctccacagaagaagcacaaggtgcttttgcagcagtttaatacaggtgacgagagggcccagaagcgtcagccgattcgtggctctgatgaagttttgttcaaggtctactgcattgaccacaccgataccaccatccgagtgcctgtagccgcctcggtgaaagaagtcatcagtgcagtagcagacaaacttggctctggggaaggcctgatcattgtcaagatgaactctggaggagaaaaggtggtgctcaaacctaatgatgtttcagtatttacgacgctcaccattaatggacgcctgtttgcctgcccgcgagagcaattcgactcactgactcccttgccagaacaggagggcccgaccactgggacagtggggacgtttgaactgatgagctcgaaagacttggcgtaccagatgacaacgtatgactgggaactcttcaactgtgtgctcgagctggagctaatctaccacacatttggaaggcataattttaaaaagaccacagcaaacttggatttgttcctgaggagatttaatgaaattcagttttgggttgtcactgagatctgcctttgttcccagctcagcaagcgtgttcagcttttgaaaaaatgtatcaagatagcggctcactgcaaggagtacaaaaacttgaattccttcttcggcatcgtcatggggctcagtaacgtggctgagagccgcctggcattaacatgggagaaactgccgagcaagtttaagaagttctatgcggagtttgagagcttaatggatccttccagaaatcacaaggcgtacaggctgacagcagctaaactggagccccccctcatccctttcatgcccttgcttattaaagatatgacatttactcatgaggggaacaagacattcattgacaatctagtaaactttgaaaaaatgcgcatgattgcaaatactgccagaacggtgcgctactacaggagccagccattcaatccggatgctgctcaagctaataagaaccatcaggatgtccggagttatgtacggcaattaaatgtgattgacaaccagagaactttatcacagatgtcacacagattagagcctcgcaggccatagacatctgcagtgcccagagtgatgctccgtctccagtccacaatctttcaaaagatgctgtgtatgctactactgactgtgttgctactagagaattccccagaatgagcaagagacacctcctgagagcccctcggggccacatcctgctttccgaccacacaggagaaggatctgtcttgtctaacgcggacatgccgtagcttaggaaccatcagctgtagtcatcttcttcacggttggcacaccaccgcaggctcacgtgaaggcataacctggcgaggctacaccaggcccctgacatcccttcccaggctgttgcagcatgagactgtcccgtggataggtttgacttggaatcgctgcaatgatataattgaatgatttgtttacttagcaccttatttggggtctgggttctggggagggtgttgaccataaaagtccaaattatccatcatgttcctccatcgtcataatcttacctctgaaggaatggaacctcatcacaacactatgaaacattatgactgttcagtctgtaatttcggaatgatctatagaataatatgtttacattgtaacttttaaaaacttacaaatcaggattacacacatgagaattccactaagaaacaccaaggttcttaatatcgccagcgttaagatagaaagtaacatttcagaagagcacaatatacacaaaacattttttcaaattgaaatattttcctgggcattaaaaaacctttccactacaaatttattgttactgatgaaaaaaaaagcatattttctggacttaaatgttattacaaaaatcttaattttcagcaattgttttgcactttcagatagattgtaaataggttatgcagtcaatggtatagaattatttatttgctacataatagacattgtgccaaataattcctttttatttattttattcagtatgaaattttggagtacattttttctgttttcttaattagactacatttaatgtataggaattgtatgtacatatctcttctgtaaataacagccagtatcttcattaaatatacttgacaagaaaaaaaaaa

SEQ ID NO: 370 - DNA, 583 bp, Rattus rattus
tttttttttttgggtttgtccggtttttcatttttgtttgtttcgctgcattttgaacactagggcttattttcaaacagcacacggttggtctgcagagcggaccaggctgggccacagtgcaggccctgcccagggcagctgccagaagaggacccaagccctgtccggtggcgcggccaagcgtcaggcaagtgcggcggtggctctgcacccccggcccgccctgaacatgcgggcatcgggaactcaactaggagggggacacagcagcttcgggaatactggagaagtccactgaactgggtcggacggctttttggaaaaccacctcatctttgggggtacacctcttggcttaggtttccgctccccaatttcccgacacttttcaagagtttcaaaacaaaacaaaaaacagaaaagaagaggaagaaaaacaaaaaaaaaaaaagcacacatcttttgggaaaaggttcttcacacaccggaaggctgcagaggctctcccgtcactgcacccgctctgtgaaattctccgggaagacgccgcggaatttctccagttccttgggctgattcc

SEQ ID NO: 371 - DNA, 502 bp, Rattus norvegicus
cggatggttaccgtgtcattcatgatggctacggtgcccatccggaccaggaagttcatgacaaaccgtctgcttcagaggaaacagatggtcattgatgtccttcatcctgggaaggccacagtaccaaagacagaaattcgggaaaagctggccaagatgtacaaaaccacaccagatgtcatctttgtatttggattcagaacccactttggtggaggcaagacaactggctttggcatgatctatgattctttagattatgcaaagaagaatgagcctaaacacagacttgcgagacatggcctttatgagaagaaaaagacctcccgcaaacagcgaaaagaacgaaagaacagaatgaagaaggtcagggggactgcaaaggccaatgttggtgctggcaaaaagccaaaggagtagttctacggtgacttgatgttctgctgtgatatcgaaatttctgagggtaaaataaactaaaaaacgttctgcgagtctg

SEQ ID NO: 372 - DNA, 470 bp, Rattus norvegicus
ttttttttttttttagtgggagacactgcagaacctttattctaagcctcagttctgttttcctgtagtacgtttttaccagtcagtcctagtgtctaatgactactacccctctcgttgtccttggctgaaggtgaacagacttgcagacttcctgtgagaacttccaatggcgtgcaggtagatgtggtgggcagtccttaacactgggcctcagaggctcttttgatccaccaaaggttggccatgcctatgcatccctggccctcacatgaaatcctggtaggcacccagcaaggatctcaagggggatatagcagtaaccaaagtctacgggtttctacacgtgcaagtgcctggtgattgaccccgcaatggcagttccgcgtgcgtcacagtgtggtgtgtgagaagacaccctacatgtcttctgaacttgtgctatttgtgaagttccctcgtgccgaatt

SEQ ID NO: 373 - DNA, 627 bp, Rattus rattus
gagagtgtagataaggtcatggatcagaaagaacataaattgaatgggaaagtcattgatcctaaaagggccaaagccatgaaaacaaaagagcccgtcaaaaaaatttttgttggtggcctttctccagacacacctgaagaaaaaataagagagtactttggtggttttggtgaggttgaatccatagagctgcctatggacaacaagaccaataagaggcgtgggttctgtttcattacctttaaggaagaggaaccagtgaagaagataatggagaagaaataccacaatgttggtcttagtaaatgtgaaataaaagtagccatgtcgaaggagcagtatcagcagcagcagcagtggggatctagaggagggtttgcaggaagagctcgcggaagaggcggtgatcagcagagtggttatgggaaagtatccagacgaggtggtcatcaaaatagctacaaaccatactaaattattccacttgcaacttatccccaacaggtggtgaagcagtattttccaatttgaagattcatttgaagtggctcctgccacctgctaatagcagttcaaactaaattttttctatcaagttcccgaatggaagtatgacgttgggtg

SEQ ID NO: 374 - DNA, 4447 bp, Rattus norvegicus
gatccacctgcctctgcttcctgagtgctggtattaaaggtgtgtgccaccaccatccagcaatacacctgttttttttttttaattgttcatatagttcagtatggccttgaactcatcaagcatgagtctgctgcctctacctccttttgttattttgagatagggtctcataccatagacaaggctaatcacagactctatatgtggtccagagtggcctctaattagagattccctcctcggtctctcagaactgtgccatatacacatacatttaaacttgggggtgtgtgggtggagacagggtttcactttacagcccaggcaagtctctaactcacaacaatcctcctgacccatctcactcttgctgggattatgagccacctgccaccatgcttcccgtgttgtgttgtttttgtttcatggagaagggtctcactatgcagcccctggacagcctggaactctcggtagaagaaagaggctatcctgggatcagtccatcgtcttcctccaagatgccaccacacctggcattccagcctttttaaaaaaaaaaacttttatctttaaaaaggcgtttagacaaaaagaaagaaaaaagaaagcagatatttaaaaagttctacagacgaaatttaacagatctttgtagaattcgagggagagagcaggaccattggccaatcgctgaggatatggagctgaaacaaagtccagattttctggcaccaattccagggttctttctgggtccaggagctattcattgactcattaattcatggattcataattcatatattcattaaattgcataaagcacctgctacttgatttcgggtaactctgggaatgcagcgctggcaaaatctaagcaccacggactttacagtccatatagggcgtcacagaagagaataacaacggtctttaagagtgatgacaagggtgtcgggtgccttggaaatcgcggaattagaagtcagcgaggaaaggagaatggcgcttccgataacgtcatttgttctcggcatttcagatcctgtccagggactccaaagaaggtagcagttaaaaacaaaacaaaaaaatatctcacagaagctctattcagcgaacatcctcacccagcagcagaggagggaggtggggcacaggtatgaaacgcatgcgcaatctcactcgtgccgccccgagggtttggaccaggaccgaaaatgtgcgcaggcgctacaattcctggccagtgagaaggcgttgcccaatgaaacttcgtttggcgtctctgtcccgcccccttcgggacccccatttccgcttccggcgcgccgggtagttccaagatggcgtcggcggtgctgagtgcgtctcgagtctctgggctgctgggccgggccctcccacgggtggggcggcccatgtcgagtggcgcccacggcgaggagggttcaggtaccggggctcgggtgggcgtgggggcctcagtggctggcacgcggcctggcggggccgtgaccttggcgggaggccttgcgggagggagcggccgaggctgacattctggtccccgctgcagctcgtatttggaaggccctcacctacttcgtggcgctgcccggggtgggagtgagcatgctcaacgttttcctgaagtcgcgacacgaagagcacgagagacccgagttcgtcgcctacccccatctccgcatcaggactaaggtacgcgctgcgcctctgctgtccttcaagcgtccgttatttctgggttgtccactccccagtcccagcccttggtgcgctaggatctcggctgcctgtctatccgcgcagactgaacattttatttactctcgttttacatgagggaagccagtttgtgggtcgcggcttaattttcttaaaaagccgcacaataaatggtcctggattttcaactcccccaatttgtcatcttttgtcttctggtgcacttcagatgctgtttcctgaatgaaagcttgtagttttggggtgtccttttatagaggcagatcctgaaggtgatttacaatccgggcgttaggcttgagcacagactgccggtttgtgtagacagttttaatgtctctcgatgaattttttttttttttggttctttttttccggagctggggatcgaacccagggccttgcacttcctaggcaagcgctctaccactgagctaaatccccaacccctctcgatgaatttttaacaaggctgtttatttgctccttaaattgtatcacctaattcacataggactagccttgcagaaacttaatctagatttttacatcccacgaggctcgatcccactcgtgtacagcctcagcacttgggaggccaaagcaggcatatctcctgagctcaagaccagtctggtctacatagtgagctccagggcagttatgggtgagaaaaaggtgcttcacagcatccttgccttggcctctgcccagtaggtggcagtagtaccccggcctaactgcctctagaaaatgcgcatgtctcgcccctgacacttgggggctgaaaataagagaatcagtagctcatggtcattctctgcttcgttatgaagtaggttatcttgggccaaagaggttatcacagatagccaaaaatggttgtgagctattggccaagagcagtgcttttcaaacatggtgggaaggaactggagagatggctcagtggtttagagtggtgctgctcatacggacagaagagccagttttaatttctagtgcccaggtgggtagctcacaacttgctttagctccatatgggggtgggactggtgtcttttggcttctgtggtacactcatacttttgtgcatatgcccacaaaggaggaggaggagtactaatgatcgtaataaaaaataaagccggcatggtagcacaggcctttaatctcagcacttgggaggcagaggcaggaggatcattgtaatttttaggtcagcctgtctatgtaggatttaaggttagctaaagaaaccctgcttcaataaaaaaaaaaaaaaaaaaaaaaaaaatcagggcttcaaagatgctcagcaggtgaaggagctagcaagcccaagacggtgcatcaatgtctgggacccactgcagaaggggagaacctatatacccacacacaagtggtctctgacagtggccgtatacatgcacactcaaaacaaaaggtactgaggaaaaggatagaatcttggttgcagttttctggtcctgcattaaaaagcatccacgtctgccatcgcccttctgatacaggaagggccacaccttgatggcacaatcctggctggagcagtttccaggggaagctaggaactgcttttcttatattaaaaatgttgattatggatagatacctatgtgtgtacatatgtacctgtgagtgcaggtgtctgtggggtcagaggtgtgagatcccggcagcagttgtgagacacctgatctgatgtctgagaattttggaggagcaagtctgatgaacggagccatctttccaacatcttatgttttttaaggtttaatttcttttaaattacgtgtgtgcatgtggatgcccaagggagccaaagagggcttcaggttccctggggctggagtagtagcagttatgagctgcctggtgtggatgctgggaaccaaacttgttctattcatgggcagagcagtacatggccttagctgctgagccatctccttccctggagcttgctttactactagccacttcagaggagagatggctcggtggttagagcaccggctgctcttccaggggtcctgagttcgatttccagcaaccacatggtggctcacaaccatctgtaatgggatctgaatccctcttttgtgtgggtgaagacatagtgtttatacataaataaattaaagtacataaaaaatttaacaagaaaaactatgggacagttgaaattatgccagtaaaggacaaatttccgtttggattttgttttatctgtttcaagcagttggcaggcaagttgtttgtgagcgttttcgggaaacatctaattgccatcttcactccacagcccttcccctggggagatggtaaccataccctcttccacaatcctcacatgaacccgcttccgactggctatgaagatgagtaaagagaacctggctcttcgcccaggcgacaagggaccacagcactgatttggaccctgactcttgtgtgtggaccacgaaagcccattggatgctcagctcatctttcctttatcagatggtgaccattactttgctcctccatccctttgctcgtaagaggagatggcttaaataaataacttgaactgagattgtccgtgggctggatgctgcatttttattctcagattaattgctttgctgcttgtagatct

SEQ ID NO: 375 - DNA, 461 bp, Rattus norvegicus
  misc_feature (382)..(382): n is a, c, g, or t
tttttttttttttttttcccttgacaagaggagtataaccctcatcttatgatttgtgcactagaatgccacttgggggaaggccaggacaaaaagagaagatctatagatccaagaggaaacactggcagaatggtatagcccagggcctgcaggctgcctcggctcatcatacggcaaggagacccaggagggaaaggcaggtgccactaattccagctaggatcatagccattccatgtctctgggggtgccaggtggacacgccgaccccggaactggaaagtgacaatgccacggtagccagctctggggacaccagacttgaggtcgtccatgacacccagggccttagcaaaggccttaaagctgtctctgctantgtactgtacccgcacctcccccagttccttccgatcattggtcctcactttctccacctgcagctggggggcaccata

SEQ ID NO: 376 - DNA, 496 bp, Rattus rattus
aaaagatttatttattatatataagtacactgtagctgtccccagatacaccagaagagggcaccagacctgattatagatggttgtgagccaccatgtggttgctgggaattgaactcaggacctctggaagagcagtggggagctcttaaccgctgagccatctctccagccctaaacatttgtttttatacttaaagattttaagttttgcaagacaaatatattgtaggagcttagtagcacaagtttctgttggtactggaaggacttgaaaagtaagtagatgctctattatttatttataaagttttattaatgacaaatatttcatgattttatgggacgttagatacaaagttttttacttcagtgtttgaaggacacttgttcagaagttatccaaacatatgggaggttagtttggcatacatttacagtattctagaaactggctgtcaagtgtgccagtaagtggaggcacttgggctttaca

SEQ ID NO: 377 - DNA, 1683 bp, Rattus norvegicus
ctcgtgtagcgtagcctccgcgcctctgctgaagccccgcgacctcgccagcagcccttggacatggctatccccatgcgcccgcgcctcctagcggccctcgcgcccacctttctcggcttccttctccttcaggtggccgttggtgcaggcactcctccagggaaagcgtttaatttaacttggatatcaactgatttcaagacaatcttggagtggcaaccgaaacccaccaactatacctacactgttcagataagcgatagatctagaaactggaaatacaaatgcactggaaccacagacactgagtgtgacctcaccgacgagattgtgaaggatgtgaactggacctatgaagcaagggtcctatctgtcccatggaggaactcaactcatggaaaggaaacactctttggaactcatggggaggaaccgccatttacaaatgcccggaagtttttaccttaccgagatacaaaaattggacagccagtaattcagaagtatgaacaaggcggtacgaaactgaaggtgactgtaaaagactcatttacattagtcagaaagaatggtacattcctcactctgcggcaagtttttggcaatgacttgggttatattcttacgtatcggaaagactcaagcacaggaaggaaaacaaacactacacataccaatgaattcttgattgatgtggaaaagggggtaagctactgcttcttcgcacaagccgtgattttctccaggaaaactaaccacaagagcccagaaagcatcaccaagtgcactgagcaatggaagagtgtcctgggagaaacactcatcattgtgggagcagtggtgttcctggtcactgtctttatcatcctgctgaccatatctctgtgcaagcgcagaaagaacagagcaggacagaaaaggaagaacaccccgtcgcgcttggcatagacgaggaggctgacgctgctgactgtcacactgcccacacggcactgttaccgagacctctgctgggaactgtggagtttgctcctagctcagaaagactcccttcatggcctgtcattccagctaatgctttgattccaacactagcatctgtcactttaggacatactgaacggtacaaattgatcaacactacagcaccttttgcacaaagcttaagattgtgtattctacacgcgggaagacactaggttgcccaggcaaagccagtggtcagatgcctttcctataacctgggtgggcttttggagaacctttgaggagtgatgccataggctctagaacaggaaagtgggatttgggtggacttttccaacagttgtacttttcgcaaatcggtatttgggttttgtttttccttctactaggtacttttggaagttcaaagtaactgccaaactgtcatatgttaaatgcaggatatttctgcttgggacatccttgtgatttgtactttattacaacttagcactttaactgacaatgatggggattgaacattggacaaccaactctatttttataagactaccatacagaagaactacatatagttttatgatctaaggtacttaaagtgtttgtggttaacattgtgtatatttatatgagttttaaaggttttgtatatgggattttctatttatatatctcctatttgtatatattgag

SEQ ID NO: 378 - DNA, 413 bp, Rattus norvegicus
tttttttttttttttttgcgaaaacttttgctttaatttttaacgaaaaacaggtaaccagaggactcgggctctgacatgccgtggacagcaaggtgaggagctaggtacaaagggtagcagcctgcagagttggtggggcttggccttggccctatcttcccatgcctcagcagaaggatatggggacacttctgtacagcctccaggaggggcatagacaacgacagcccaggtgggtgctcatgggactcttaacacaggtggcgaaatttgggtttttatcttcgggccggccatatttcctcatgcactcttgatatcttggatagaaatagtccgtctcggggtcgttctcgaacacctctctagcctcctccttgctgcacacctcctccacgcactcccgttcc

SEQ ID NO: 379 - DNA, 580 bp, Rattus norvegicus
tttttttttttttttttctgatcttaattcattttattctacaaaatgctactcagtggaaagtaggaaagccaacaagacaacaagaacataaaacgagaacaaaccccgagggaaaataagttttaatatgttcttccctccatagcagcaagctctaaacagctttccttagtgcaaatactgtaggcttgtgtcacacacagtacacagaacaacgcaacacacaccaccacagatgcttctgagcagagatactcctcaaaaatttaaaactatacaaagattttttgagcacgtggtcctgcctggagaattcgactagagagaccctcctaggaccatttcaccattactgtaaaaacgggacaaaaggtccccagaaaggaaattagaattccccatggagccataaaaccttgtacaactcgtttgcctccagggtctaatagcaaatttcactgcacgtcattgacatatcccaaatacggatgcataaagcttgagtttctacgatataccaaaatacgatatatatacaactcccactgcaaaagaaaccctgatacctagtctttat

SEQ ID NO: 380 - DNA, 590 bp, Rattus rattus
  misc_feature (390)..(390): n is a, c, g, or t
  misc_feature (509)..(509): n is a, c, g, or t
aacggccacaatagtttatttacaattgaactctttataagatatttacaagacagccgactttacacatcagaaatggtatcaaaagtatgaattacagcacagacaacgatatgaaacaggcataaaacaaagctgaggtggagagacaagcactttctcttttaatttattaacactagcttaaactttgttaaagaaagagtaaggaactatgttttaggagaactgcagggcctctctttctgttgaaggctgaatctcacacagtgttgtatcccatgtaggggaaaataaaattaattccccacacactccacacactgtgctctcgctcctggaactttgctccaacctcctcctcaaccaacctcagcatctccaaaccanaagacagctaggagaggacataatcaaatattaggtcctcagggaaaggagaaccaaagcaatagaatccacttcagtcctgccagatagcacctcatggattcctctcagtctagcanaaacaggatatgaggactcctctgaatagggcagaaactggcggttagtctattaacccataccaaattaggaatcgacaa

SEQ ID NO: 381 - DNA, 664 bp, Rattus rattus
ggccacagtcatggcattccctcccggtgctcttcaccctttaccaaagagacaagcacttgcaaaaaagcaacggagccagcacggtcttcaaccccagcgtcttgcactaccagcaggctttgaccagtgcgcagttgcagcaacacacggcgttcattcccacagtacccatgatgcacagcgctacgtccgccactgtctctgcagcaacaactcctgcaacaagtgtccccttcgcagcaacagccacagccaatcagataattctgaaataatcaacagaaatggaatggaatgccaagaatctgcattgagaataactaaacattgttactgtacatactatcccctttgctcctcaatagaattgccacaaactgcatgctaaatttagttcttccggacagaccgcaaccctaaggctagttctgctatgtcatatacgagtattaaatatggtatgcttagtatattccagcctaagatagttaactacctgagaccagctgcgatgttcaaagacatacaggatgaggttttcttttacagggttctgagcgtagtttctgtcccaggaatattgtcttatctccataactatagccgatgcaaaaagcccacccagtatacacatttcgactcagaatacttcaaatttagc

SEQ ID NO: 382 - DNA, 566 bp, Rattus rattus
  misc_feature (531)..(531): n is a, c, g, or t
aaggaatatagcatttttattaactactttaagtagaacaaactaaatacatatttaacagttttggttcatttatacagtacattaaataagttatgcacagagttaagtaacaaaagttcctattgagtcaaatgacaaagcacagaaaaaccagactcaaatgcatcctgccggtgacttcacattcatctgctgcctctgcaaaccatgcttgcaggattggcttttatttacattattggttttctgtagggatggagccgttgtagcctcatcaggaacttggaaagccacaggagtggaatgaaggccttatatcaaacagccctttaaccattcgctggattgttacagcttcttccaggcaactccaagccagggactaggctgtccctgactgcagctgcacatgccctttttggcataagcactgacagtttacactgggcagcaggaggtctgacaagacggggtctaagcggaagtaccgcctcttgggctgtggaagggaagatggtgaaattatcnaaccacatctcggctttctcctggctcacacttgc

SEQ ID NO: 383 - DNA, 506 bp, Rattus rattus
aataatacattatatcatcagtagaaaacaaaacgaacaaaacagccattttggaaaataacgtgctaattgcccaataccagggaaagcaggtcccctccctggactctactggcaagcccaggtatgccctgaactctagagtctccatcttgtatggatgatgaagcattcaagtaaacggtgaggcattctgggtgtgagtttctgagaggtaccacctcagaggagactccagaacagccgcagccctccagttcatccgtggtatcgcgtggtcttgggattaaccagcagttttcttctgaggaactgtgataattgtcagcctcaggatttagtggttataaaacaacttccatattaaaaaacacttgagacacacgaacatgattctcatcgcttctccaacttcttgtacttggcttctagttgaggaagaacaggaattgtgtctttgaacactagtgctcacaaagatattttttagttagattttcaagcaa

SEQ ID NO: 384 - DNA, 621 bp, Rattus rattus
gttgattacccattccatacacagttgtacaaagttcaagtgaaagggtgtgcaggggcgccatctctatgttggtttaaagtctatgggagtttgtcaaaggggcgagccacagctccgattctacaacagtgtctttcccctgtttctactagatcacagcaaaatgccccgctacctgaaagaccattgatacattataaactcttatttatatactcatctttttatttcttcatcatctttcttcctctgaagaagctgacagctgctgatgggaagcacaacatttgggtcccgtttaccgctgtttatgttattacttcttctttgggtgctcacaaacattgcatgctacatgttacaaatcacacatgggggactccagcacactgttatcttaatttgacaatgaacacaaaagggagaaatttcttgtcccggaaacaaaacactatggtccttctgtggaactttctggtataggacaaacctgatactatcactgagctccattcacactggcagacaagagagatgcgggaacaccagtatacaatagtggaaggagaactttcagggacgtgacatcccacgcgatgtcacaggtactgcctcagg

SEQ ID NO: 385 - DNA, 652 bp, Rattus rattus
agacagtaatgcatgtatttatatatacacatatatacacaatgtataaatgaaatccttatataagcataggagttctcttgacagaaataaattataagcaatacaataaaaatgaagcttaatttaacatagtggtttgttttaaataactaaaacagatttatacttcaacaaattttggtcatttgaacacaaactattctgattgacacgtacttttttatacagcaattcaacacaccctgagtttcacttcccaattgatggttaaatgcttatcatactacggaaataaagatgtttaaaatgaagagcctggcatcttggcgtttagttcactgaaattgctttgaacagttcagttagtttatgtcaaaggacctgtatctactttgatttgctctagtgactctggagagctaacgatttgctccaacgcagatatccaacgagaaggtgaaatcaggacgcgcaatgctctgcccaggagccatcacctcactctacagcttctgtatcatcacctggaatttgcaggcaggcattgaagatacttcagctgtcacaatactttttattcccaagtttgacaagccacctctgattaagccacatgtaaacgctagatacttggatgcatgttctaaat

SEQ ID NO: 386 - DNA, 492 bp, Rattus rattus
aataaggtgttctgaggaaccaggaaattaacagagaggggcgaataagtaatgcttcttaagccctgctcagtatttcgtcagtcatcttctggtaactggatcttgctgggatcaaaatagttggattccatgatggggaggccgttgagttctcggtatttcacaagtctctcagcttcccggcgggcccactcttgcatcctagattttgactttattttcaaatgaataattgtccttacctacttgtttgggagtactcgccctgtctgttaagctgcaccagaaagtgctatttataaaggttaaaaaatgtttggatgttggcaatttcctatgggttcacttaatctatagcaccctatacatttaagatcctcaactagaggttaggtacttatatattaggtcttttcaaatacacaaacctcctaatatgcccagtagagaggaaatggcaataataaacaccttataattctgagtatt

SEQ ID NO: 387 - DNA, 627 bp, Rattus rattus
ggcatttcaaatgctactgctgtgagtaggatttattttaagaaatgaacgacagctgatacaaaatgtttgcctccaagaagtatgtcatacttacaagggaaaaggtaattaatattgaacattttccttgttcaacggttctaatttttataagggttttataagtctcatagtcactaagcaggttctttttgaaaggtaggcttcatgacccatttgacttcgtgcctttacatgacatgacaaattattttattcaaattatgttttccaaaagagagggttctgtgctagtcgtctttgaaagttttcataccatttcagaaccacatttgctgggatgaacatttccgatggatttggtgtcatctgggcctgagagagagcaaatgatgaagcaaaattgtagaagttgtccaacatcttctgtgtgaactgtgtgaaggagtcaaccgaggacacagcggcactgcctacgggagtctgctgagccaaactgtccaacaactccaccgagattccaatctgggcaacagatggggttcgcacaatattcatggctccaaatgggtgctggcttccttctccagatttaagacctgatattttgaagatggcacttgg

SEQ ID NO: 388 - DNA, 370 bp, Rattus rattus
gaaaaatagtcatttaatatttaagggagaatagaaatcgtgggtatctaagtttgagcgaccccaacaaaccctgaaacaggaacaccttggggttcaaaggccaaagttgcgtgagcagtcctcactgtcccgcctgtgatctacctggaacttctcatttgcagccaaagggcccagcaggatcgaggcccatgtggctacttttcccactgacgtgtatacaacaagttatcagaaggcacacaattcatagtgcaacagagaaaggaagtcaggttacagactggctcagaatcaggccagagaccctgcacttcctcagtctgaatacacaggtgcatgaatcccacacctgaggactcctgca

SEQ ID NO: 389 - DNA, 549 bp, Rattus rattus
ggcaagtaaaattttaattgttctagctagaaacaagcatacattacagatataacacggaaatatattagacgaagaaggctattataaatttctcaataactaaaataacataccagcagctactagcactatcccatacatggttccaactcttcactgtcccctcaggctcaacatgtgggtattaggggatggctgaacttggtgtgggacacgagactgtcaggctggcatgagatgagccttgttcctgaatggacatggactgcatgcactcattcagtagatcctcttcctttgtctcatcgttcatgcatggctgataatccttagaagaaactggtagcaagaacagtctgcctggtcttctaaaaatcttcagggacttgcatcttgttttagatgcatatccaatttttaacccttctttgtgtctcaggggtctccaaagggcatgtatgatcatttcaggtgcttctgctgcaatgcccagagagtcttctctctccagatggtgtctccatgtagtgcagggggaatgctgtt

SEQ ID NO: 390 - DNA, 561 bp, Rattus rattus
gtttattttagagtgagaccatgtcactattataaatcctggtgcattcaaggtaaagagttctggtacagacacaaatcatgacacacttcagtgattttatactgagtcatgtatgtgatataaaggcacattgtactgagtaaacaaaatagctgttaaattctccagcttttaaattagaatttcataaagtgcttcttataaaatcttacaatagtaattagttacaatttctgcagcaaaggcacctgggagttcttggcagtcgctttgtcttacgtctcctttcagcttggtatttctcagttatcttctttccacttaaactttccttagtaattcttcttcagaacagccagcccgtgcttgatgaggtgagctgtaaccgggcactagaaaggccacctgtaaaggtcttgggaatttggcaatttttatgaataaattgattaataatttaaataaaatggtattcaaatggcgagtctggggatgatagacagtacagtccatgattggagatggggttttaaatatccgttttagctgtaagttttt

SEQ ID NO: 391 - DNA, 597 bp, Rattus rattus
catagtcaacaatgtgttttactatacatctcagatttatacatttcatatatgcttttaaagcttcaattaacagatcaatacaaaataaaatatatatatatttatatatgtgcagcagtggttctcaggcacaggatttaggaggaggatggagggagtctttccttggcatgtcaaccatgatagtggaacgtgtccttctgacttagctgccttgattgaactttacatggcaaacagttgaacatgtatgccattgctcattggaaggataagatttgaagtaagttcatagcctgcatgttttgaagtctttaagacttaaatgcttgctttcctcctacgagctccaagatcatcctatgaaaaaaatatgtccacaaactgtctggaacacctgcctaagaaccactgcctatggttattcaatgtcctcaggcctcacaggatgaggtaatgggatgatggatttcttctcagtgtccctggaaagtgctttcctcatatcgtaggcatcctcatcaggctccccattgctggctgagtagtactctatgactgtcctgtagacactataacccaactgcttgtaca

SEQ ID NO: 392 - DNA, 591 bp, Rattus rattus
ccacatgaaaatgaaattacaattataagcatgaactaggaaacaaactgtaagcatgaactaaaaattacaaggtaacttgctacataaccatgataagacaacgattacataccccgtaagttctagattttacaattccaacacaatgttggtactttatatatagacaaatggcatatttaaaagtctttcttctctttctctttcgtgcatctacaagtactgtgtgcatgtgcacaccaaagccacaatgtacattgagaaggtcagaggaaaatttacagattattggttctttccttttaccatgcaggtcccagggatagaactcaggtcatcaaactccaacaagcaccattagctgccaagtcatcttacccacacggatgttggaatcttaaaaatattttttcacatttttcagttgattttcaaaataaaaaaagtttagtatacaattacaggcactgactttttaaatagagattcacagtaactttaagatacatttacacggaaatatatagacaaaatagtttgctgagtcaaaaaggacttttcccccaaaattaataaaattgagattga

SEQ ID NO: 393 - DNA, 542 bp, Rattus norvegicus
  misc_feature (315)..(315): n is a, c, g, or t
  misc_feature (528)..(528): n is a, c, g, or t
tttttttttttttttttcagagtgctatacccaatcatgtaggtgtaatttatttatgttggaaatacatagatcacaattcttaaggaaagagatgtgccccccaaagtttgcatttgcacacatcagctacgctgagggcattgtcctcgggtttaacattaagacccagtgggaaagcttatggtcttatacactgggtattagccatgctaggtatggccatctgtcagacaaaggggcctagtctcctcccacaagtcatgtcctaagtcatctgcgtattatggcaacaggagcagcagggctggctanagagaggtatggtttggccagttagtattgacatcttagaatcctgggggtacatgtgttgtaagaagccaccttcagaaggctgacggtactatactggagaagctgtggaacaggctgcactgaccagggcaggctttcttagagaagcctcagctattggtttcatacagtttccatttccaaggaggcaagggcctgtttggtatgcanagagactaacaagg

SEQ ID NO: 394 - DNA, 601 bp, Rattus rattus
cagtcttagtggcacaggctttaatcccagcacttgggaggaggaggcaaaggcaggcagatatatgtgagttcaagcccatcctgatttatgttgtgagttccaggtcagctggggctccatagtgagaccctgttttccgaacactgtatatttcatgtccaagtgtggctgcttgccataggtgatgaagaactgagatccgttggtgtttgggccattattagccatagatacaacacctcgaacattgtgcttcagatattcactgtattcatcctcaaacttcttgccccagatactgctgcctcctcttccagtacctgttggatctcctgtttgaaccatgaagcccttgatatttctatggaacacacagccattgtagtaattactggcacacagagccaagaaattctcacaggttttgggtgttctctcacagaagacttctatcttgatatctcccacatctgtatgcagtgtcacagacattctccttcttgatgcttctagggagcactatttactttttcaaagctcctcgctcagcaccgctgctgcggtaacaaaaatgtctcattcacaggtgccggcatgc

SEQ ID NO: 395 - DNA, 603 bp, Rattus rattus
ggggaggaaaaggtttattcagcttacacttccacattgctgttcatcaccaaaggaagtcacacagggcaggaagcaggagctgatgcagaggacacggaggggtgttacttactggcttgctcagcttgctgttatagaagccatgactaccagcccagggatggtaacacccacaatgggctgggtcctcccaccttgatcactaattgagacccttacagctgggtctcaggaaggaatttccacaactgaggctcctttttctgtgataactccagcttgtatcaagttgacacaaccagtcagtacagcaagggaggaatgctgcttactggtttaagtatagtacccaggtccaccctcccacctcaacaaggaaacaccctaaaggcttaagtccaatcttacagaggtagtttctcagttgagaattcttcctgtcaggtggctttgtcaaagagagacaaacctagctaacagtggttggaaacctgcctgagtgaaactctaagtgatttctcacagaacatttcctaattcatgtagcaaagcctgcttacagtttcatcgggcatgctctcaagaagtccttgctggtca

SEQ ID NO: 396 - DNA, 436 bp, Rattus norvegicus
tttttttttttttttttacaaccattcatagaaattttattggacaaagcaaaatgctcttcaataagcaaacaaccataaaaacatggtgcgtccgcaccactcagcagggaagtcatgcaatttctggaacagagcacaaggtattacactgagtgagagcatctccaatgcttctgtcaacacgcttccatctcagcgctgcagagctggaggagagttggtatggtagcgaggtatgaagagttaggtggtagtgaggcagctgggtgactataagacagaatcaacgggccctctggagtactgagctcgttctatacattggtcatacataattgcatgaatcggcacacatgataaaatagcacgaagccacatacatactgttccaattaacaagtccttgcttttgatatgttacaccatatgttct

SEQ ID NO: 397 - DNA, 412 bp, Rattus norvegicus
ttttttttttaatgattacaaaaaataaatatgtgtttatttttaagaaaaagaaaagcactggccaagaacaaacactgggataaagaagtcaccgtgtcctgccaaaacaacagacacataggacacagccaagattaggtgtctagcccaaaggtcagagtgacagcaagttgctgtccgtgtctcttagcaagactccattagagctgggtgcgaggtgctgctacaggcacctcagcatcgcacggcctcaggaggtcacatgtcctcaacactccacttgtaggcaagctcctccacagctttcttgctggcaagcctggcaaagcgcttctgttcaaagccattggatctgtccactccatcccagcgataccccggccaaatgttgaatctattgggaggagga

SEQ ID NO: 398 - DNA, 401 bp, Rattus rattus
actccatcccaggtgtgctccattccaggcatcttagacgtttcccgaggtctccggcttctctttctccagatgtttcttttgggggcccatgaaggccctcttctcctgcgctgtctggaagcatccgtggccaaacttagaagtggtgtcaatgaacttgagctcaatattctccagggccctgcggctgtggtgcactagtagatgcgttgtttctgaccatcttcccgtcttccatgtgcagcccccggccaatgcggtagatcttcttgttcagctctgtacggtggtggtaacccttctgcccagcccgggcgatggagcagcctactcgggcagggtgccaggcaccaatacaggccaccttgcgcaggcctttgtgggtcgtcctaggaagc

SEQ ID NO: 399 - DNA, 545 bp, Rattus rattus
cacaagttcccaggcctctagcttttattattgccctgtaaaccgcaacagatgaagctgaaaggaccaagagaacaaacgcatcacctgaaccacatgaagaaacagccacagaagcttgtgtgcatccgagtgaaaatacagagtatttattcctttcttcccactagaggaacagacgaatcatcagttgtcaggagttgattttggagaataatcaatgaactccttttcaggggttggatattgataccaaggtccatcaccccgggcacgcatcagtcttcgaacctccagctcctttaaccgtaagtcggccttttcagactcgatctggaggatagccagggtcttttcatagttcttttcaggtccatcgtagaaagtccgggcaatccatcgtgatattggatgcttgtaatactcccagtgttctgggatgtagccttctgggatttctgcgagttcagcttcaccaataaatatgttcaccagtgttatgccgattataactgggatcccagtcaacaaaaggtagaatttca

SEQ ID NO: 400 - DNA, 593 bp, Rattus rattus
ccgggctcattaggaaacctttattgtcaccattagagataaaaacatcggagtcccacacgccacaccacacaaggaggctaactgaagggttactgattgtcacagcagcccagacaaagggctgaacctcggtccttagccaccccctcccctgcacgatcagtggcagagggcaatggtctccatgttgaggaagcggatgtgcatcttggtctcgatgtcgatgccctgccagatcttcaggaagtcctcaaaggtgatcccctcgtacacctggtccggttccatctgtcccacgcacacgctggcagcctccatcatggctccgtcggcgatggaccgagctgactccttctcgatgtgaggatttccagagagcagttcctccaccacatttcgatactcttccagggtgatgcggccgtcactgtccgagtcatacatatggaacagaaatttcagcttctccttccgagacagctccacttgttcctcacccagggtagtgtcaatgggccggaagtaggacatgatagtcaggaagtcctcgaagttgatctcatcggccaggccgctggaccccttacgca

SEQ ID NO: 401 - DNA, 569 bp, Rattus norvegicus
tttttttttttttttttaggtattttttggtgtttatttaaaaattaattagtatttaaaaaaacataacagcagctaaatgtcaaatgacagcatttctgccatatttatttttgtacagaagctagtagaaaaaaacaaataatgaaacaacccaaactgaagaatggtgactctactttgtaaccctgtgtttctcaaagattagagggtcagataacttcgcacaaggtggccaaggagcgtccctagaagtccaggcgcttcttgcctccggtcatcccgctacagcctgtgcccagcagagtggtggatggtgccaggtcctgtctgcttgaacggcccactgtgtctgacaagtctggaggcagatgcagtcgctcaatggtgaacagcttcctttttaacttaaaagctaagtctttgacatccgattcatcacaagtcaagttattaagccgaggaatcttccgtatatggattagaccatgataatccttatacaatgggttggtctctctctctgaaccaataaaaagatccagaccaactactgtatctgacaaatt

SEQ ID NO: 402 - DNA, 533 bp, Rattus rattus
tatttgtgggtagtcatagaagtcaacagaccagcacagaacagacacagctacacagtgctcatgtccacaaacacactgacaggggacagcacacagggctgggagacttgggctaagaccacctaagtccagagcacgcccctcctgcacagcagggattgtggggccaactgtgctttgctctaaagaccaggggcctctggggaggtgaggtctctgggaaggactagcagggtcgggccagccccacagtgcagcccatttgacaattggtccaggtttgcaacacatgggtgagattctgacatgctcagtgccaggaatgggcagctataaaccagagcattcacgagtaacaggtttcattcttcgagggctttgttcatgaagagttcacctccatgcacaatacactgacatcatacccccatcatccaaaaaaaaggtgttgggtgttttgtgggaatcactcaggcctgagctttgagaggacattgcttctgccttcctgctctgtgagttatgaggga

SEQ ID NO: 403 - DNA, 139 bp, Rattus norvegicus
  misc_feature (124)..(124): n is a, c, g, or t
  misc_feature (127)..(127): n is a, c, g, or t
tttttttttttttttttgagataggaaaataaggagtttaataattggagggggcagcacacacactgcagcagtcacaccggtgcggtctgccagcaccggctcctgcagtgtcgcagggaangangggttggcatga

SEQ ID NO: 404 - DNA, 442 bp, Rattus norvegicus
tttttttttttttttttgacattccacaaagaaatatttattgagcgcctgccacgtgccaggcaccgtttaccccccaatgagaaaacaaaacggaacaaaaacaggacagaggcagcagaaagaaacaaagggcagttggaaaaaagctaagggaactaagcgcttgaagagctcctggatggccgtgctgtttccgatgaaggtgactgccatcttgaggcctcgcggtgggatgtcacagacagccgtcttgacgttgttggggatccattccacgaagtagctgctattcttattctgcacgttgagcatttgctcatctacctccttcatggacatccgtccacggaagacagccgcaaccgtgaggtaccggccgtggcgtgggtcacaggcggccatcatgttcttggcgtcgaagacctgctgggtgagttca

SEQ ID NO: 405 - DNA, 418 bp, Rattus rattus
ggggaaactgggcagtttattgacaggcatcaggagactgcgcagtcaggtccgtgggcgggacagcacccgagtccaggctctgtgcttctcctcgggccttgtgggcgcaaacttctcctgcagtttcctccacacactcttattcatctcttgaaactcctccaaagtgtctgtggacaggatcagcttgtactcttccacggacaggccactgaagctggtgtctctggggcagggtacttgtgcttgtagtagtttgaatgcagtcgtgctaagctctcgtacatctgatcacaggcctcgggttctgcaacctgggtgttctctccctcccgaaaggcctgtgctacccgctgccgcaggtaagcgcccaagtcccggccccgtttggtctcgtccactggcccctcgtgcc

SEQ ID NO: 406 - DNA, 562 bp, Rattus rattus
cttgcggtagccaaactttttttttatttttttttttttttttttttttttggagaccatcccatgtcctttattgggccagcaatgctggaagctttgcaaagagtgaggtccccgctgggatgtctgtggcatcttggtcttgactcccataatgctggggggcaaggtggcatccattacttggtgtgttctttgacatactcccagccctccctggagtattctcgagccttggagggggccacggacaaggctgccatgaccgagatgatgcctgagttccaggaatcacggaagttcggaaagttaatctttggaggggctgggagctgtgacatctccagacccgtctgctggcacacatattggctgaactggtacattgctggtggcacaacttcctcggccttccgcaggacagcctcgctcttgtcactaggccccagcagctcctggtcataaacaaggtagactgctcctccagccacacttcccttgatgaggaacctcattagcgaccacactcgagccaccatggtcggtctctcacttcactcgc

SEQ ID NO: 407 - DNA, 314 bp, Rattus norvegicus
ttgttccttgagctcaattaatttatattccatgttacctttcacaagggctctcaaccagccacaaaggaagcatcagtgtacatggtttggtcctgagcaggtagaactggttctgggggactgagaaagcaacaatttgtagcactttttgctaccagccatggcttccaagtcccctatccggctacaggtgtgtagatccaattgacagatggcagtggcttcagctctggtgccaactcatacatcctaatgagactttccctaaccggcacaaaccaaccagaacgcattcatgttcacgcaagagt

SEQ ID NO: 408 - DNA, 472 bp, Rattus rattus
ccacataatattccaaatacatgtcttacagataagggttagtatgagtatcagaaaacatcccagggaaggaagccattttagacactggaaaatgctaaccaaaaaaccaatgcttacatacacatgtctggaaaaagctcaccacctaaagtgcaaagacagaagcaactaacgttctcgctgtatgaaaatagacaatcttctgaactattagctggctttttaaataggctccactggacaaaggacaaagggtcagtcgtcagaatgaatcaggctttaaaccaatctggctttgaccccaatcaactgcaaacaaagtccaggttgaggctgactagagactacacgccacgtgggatcatagcctctagcactttctacaactcagacttaacccagttagaagtgagtatcctcagatcagtgcctcggcctacccgccgcacaaggctcccggacatgtgtc

SEQ ID NO: 409 - DNA, 448 bp, Rattus rattus
caataacatctacaaaaaatagttttctctaacaattaggaaacaaatgtgaaaggcaggatggttcacattatagactcaggtagagacttgtacttcatatagatgagaaataccaggtctacaatttgtttaattgactttggattttattacaaaagaaaatacgattgcaattataaatgtcataaaaattgtaactgtattgagaagttacaccaaagtatcaaatattatataaatggacaataaatttaaattttaatttaagcttaacatagtaaacactggaagacaccttacccctacaatgccaaatatcttaaaggaatacaagaaaagctacagtacagaaacaatgaatgtgcaaaaaatatgattagagaccacagagctggggtttacactctaactacatacagttaaaaatttaaaataatctttacat

SEQ ID NO: 410 - DNA, 575 bp, Rattus rattus
tttttttgaagagcacaagtatttttatttctttctttttttttctttttttttcctttttttcggagctggggaccaaacccagggccttgcgcttgctaggcaagcgctctaccactgagctaaatccccaaccccttttttatttctttaacaatgcaaaatatacacgttgacttgactaggacatattcacatgtaaattttttctcatatccacaactctggatagatcagaggaatgacaaagatcatcacaggaagcagacaaattatgtcgccttgctccgagcactacgaacacaatgcctaaaggactgtagtatctccaaagtttattccagtccatttcttcttttatactccaaaacatcttcgttgtgttggtggatgagataaatccacatgaaaatcgaggtgcccaaggtcagcccaactttcacccagttaggtttggcattgactggctcccggacatagaactttgaccgtgttgaagagcagctcggcagcctggcgggggccagcagccgcgaaaacgagcgcagtactacgggcggcgccatcctcgtgcc

SEQ ID NO: 411 - DNA, 673 bp, Rattus rattus
ccatcacaataaaagtgacacagctttacaaaaataaatttttattaaaagcagtaaagtctgagcaggaagacagtacaaagaatgtaaacaatgtaaacaccactacattcagctcagcctgatcggatgctgaaagacaagtctaaatgctctagtccctttgctagcaagatacattaattctattttacacagacaacatattctaatttttactagggaaaaatagtttatcgaagtcgatcccaacgccaaatgctggcatcatcgcagacagctatgaggatgctgctatccctgctaaaactggtttgtcgaatagcagcgccacatttatgatgggtcagtgttgtgcatttggctttatgaggatcttctactttcaaatcccaaacatacagtttgacaacctgactgcccaatgcaagcattaggtttactttaaccatatcatcctcaatttggcaggtttcaacaaaaaaggcattttcacaaaactgggaaatacaaaacgcctaacatccttcaaatcaacataatccaagtagtccgggtaaaaaatcgggaatggatttcgggaataaaggccggaagtttgttgggtaaaaccaaaatcctaaccatcaaaatccttggtggtctcaaattagagggtcaacccgggaatatt

SEQ ID NO: 412 - DNA, 499 bp, Rattus norvegicus
tttttttttttttttttcactttgtagttaacggctcccctgcccctgtaaacagttttatttaattttaagaatcatgcagcaatccataaatattgcatcttgatgtccccactgtaatgtgcccacaagtgtactccagggagtgtgaggggtacacagatggcacacacacacacacacacacacacacacacacaccccaggtgtgcaggccctaaaacaaagtgagcaaccagcagccaacaccaggtggacaggactagctccccagtgagatggcttagtgttcaggtttgtgcccggcagatgccacagcaggtaaaaactctggtgggatgaaattaggtaaagcaaaaggctccttgaggagactgagatcactacagtaccacgtatagaaaggtgtggtgtggtgaggagccaaaggcaccaagagaacgtgcttgccctttcgcttggaccctgacaaaggaactgtttccaaatggactgggta

SEQ ID NO: 413 - DNA, 483 bp, Rattus norvegicus
tttttttttttttttttaaaaaaaaaaaacaaaccaaaaacgatcctttaataaaattagcccattgaatctccccacttcttaaggttctaaacttgtaatagctgcaaaagttccagttcagaagccagaggctcagtccagacagggattcaccgacttgtgctggtatctgggtgtttgggttgtagtttgagttaagggagagggatagctaggcccggctcctctagtcttctgcggcaggtatacaattcttctgtccacaggccaataggcgttccctgaccctttccagtttatcttggaaaaattggcttcacgttataacatgccggcctacaaatgacgacagggtcaactggtttgagaggccagtaagggggacacagagtgaaacagtatgatccgcttctcaccaaagtccggcaatcaactcacttctgaaaggtccaagagagggctaagcaccaagctgaaaac

SEQ ID NO: 414 - DNA, 371 bp, Rattus rattus
  misc_feature (113)..(113): n is a, c, g, or t
  misc_feature (303)..(303): n is a, c, g, or t
  misc_feature (349)..(349): n is a, c, g, or t
gcctcgccacagcctttattgcgcgggcactccaccgggctctgcaggatgcacgggggctaggatgtcagagcggggaccctctggtttgttgagggtgacctatggcgcantgggagacccccagacccggaactctattaatccctggtcaggccaggctgaagagggatgagctgacttggacaagctggattcagcccggttctgtcacttgggtgcattgaagggcagcgcacgctggtttcatcgggttgtcaggagagcgcaaccactccttcttcagcagctgcttcagctgtnagagccgcatgttggggttttcctgcttcaaccgtggcagcttcanctcctcaaatgcggtgaaggcc

SEQ ID NO: 415 - DNA, 381 bp, Rattus rattus
agctcaagaattacacactagccaacattagtatatatttacatgctgaaactggctgcaattagttgaaattcatgaaaataattcttatgtgctattcattgataatccttttttgaatttgactaccgcgtgtatcccagagattttagaagtcctgatgttagaaagacgtgaaaacggatgcagtgagtcccgctagtgctttgcatttttctagctgttggggagtgagcaggatgtgtgtgttcagaaaggctacaaggtcattgtaaggctgataatcactacgttgtgaagacacgggaccatcacttcttataaaaggacagttcagaactacgcaggaacaattccataacagaactatttaaacaccat

SEQ ID NO: 416 - DNA, 542 bp, Rattus rattus
ccaaacggttccaaatactcaactgagaactttatttatacgttattaaaaaggaccggcttcttctgttggacaacagagcccaaaactcctttcccccaagtccactactcacagcttgactgaacatttacccaaggcggatcactgtcactgctattcattcaaaacagacagaaatcctgagtgtgggttctgagaagacagttgtgcctgtcttgatggtgacaatttacatccatggactctgctttgctactgagtttctgaaggccaaggctcaggaggactgccttagcaacaaatggttattcctctagtctgaagacatgaaggtggccgaggctccggagagtgcctttgtgcttatcatccatgatgccaacatgtcccgtgcttccgttaccacgctcagcaggacctcagtggcttggcatagattggctccagcacatgatgagtaagaagcaggaagaggcctccaagaaagacagcactgagaaaagccagcaggacatagcggccgatgaaaaaggcatcca

SEQ ID NO: 417 - DNA, 530 bp, Rattus norvegicus
tttttttttttttttttggctttatagtgaaagtttattgtttttaatccaagtacaatcagctactagttacatacagtaaaaaacaaaacggccaccaagcaatgatgatagtctgtgacaggtgcagaggagggaatcttgttgggagtcctgtggatccacacctgacttcagcacttaagctgaccctccctccccagatcagttaaaaaaaatattaacagtgtcttgcttgggtagagcaagattctaaattttcttggggacactggagaacttttaaaaatgaaagtggtaaaacaagattgaaacgtggagacacaagaagcttcctgacaaagaagcttcaggaggtcttggcttcaggtcacctcaaatcgaatcagcttagaggagtgactccattcaaaccaaggctcatatgtatttggtccggttgagggctctctcagccaggtggccgctctcatccgtgatcttctcccagtcagtctgcccgaccacaaaacctatggcccttcaacatc

SEQ ID NO: 418 - DNA, 505 bp, Rattus norvegicus
tttttttttttttttttgaaggtttcaaaggtactttatttctttattttttttcttcaatatgccatgttttaatgagtacatgattctttgacttggcattcatttatgagttggttttttgaaacaattccttgattattgtatcagctggcatgactactgatctctccattcctttggggtgactctgccaacaggggacaggttccattctattccaatttgtgtggctgtatatgtccatgcagaaatacagaagatgcttccacctgctaatacagcatttccatatttgtcatggaaagtaggtgtcttcttctgatggctctgccttgccaccacttgctgaatgcttcgaacttggagacgacttagtgcgtttttggccaagggcaacatcgcggagacaaggatggaactgcggtgactacagctgctacctgggtgcaaattcaccccagctacccttgcagagtcctgaaaaacaaataaaaaaaacctc

SEQ ID NO: 419 - DNA, 432 bp, Rattus norvegicus
ttgtacttagaagaaaaaaatcaaatagtaaccatacacttgaggaataaaatgttacacaaaaagactttcctcagtcttatttgtgagaggaaaatggaaacaattgtcctgtcaaatgatgacacattaaggtaaaacattgtagcatttttgtaaagaagaattcaatctggtaaaaggtgagaggcttgacaaccatacatttgtgccttggtttttgagaaggatttgctatagtctaggctggacagacaactcaatcctggatcactggagttatgaagtttgtgcctctgtgtttttctggtgctgagactcacatatgctctacacaaagctttacttcgataacattagttttaaaggctagaacatgaacaacataaatgctatgtttcccaacatttaaggaatatataaaaattactt

SEQ ID NO: 420 - DNA, 489 bp, Rattus rattus
agatgactcaggactttaatgttcttcatatcgtcaatcgaaaacactaacacatgaacaaccagaaaagacctcagcaaagatctggaatgtacagattgccctggttaaactacaaaaacagccatgcgatcacagtttgggggtgggggtgtaactgagttttgtttaacggtctaaccgaaaagcaaagaaacaaccatttcttctacttgtggcaagaaaagttaatcatggaactcctagatccttctcatgaagcagctttaaaagaaatcgcttctccagagcttcatcccctttgctgttaccaatgcgaaacggaatgttcatcctgcttctattctggcgctccaccggacacacataaaatccttgagaattatcaataatctcataaatcatttgggatttgacggagctgagcttctccatggctgcggacccaccattgttactgatccattccaggatcatgcccatgacgta

SEQ ID NO: 421 - DNA, 520 bp, Rattus rattus
atttaaatgttctgctgttttagattcttatagtattataagaatgaaatgttttatgaaacaatcacttgtctgcacaggataaacacagggttaagcacacttaatcattctgctgagatctgaatgcccatctcgactgaccatacacatgtccaggaggcaaaattactcttcttacagtgcatagaccaatacaaccaaggtattgattcattttagaaatttgctagcatatgtattttcattttgagtacaaccttgtatcacaaaataaacgtatttccaaactgagatatctattttgcaaagctatactttaggcacattgaccattccaaaaaaaaaaaaaagaagtgatttttcacaagtatttcctaagaacccaccttgtgccaggagctataattaaacataggacttacagcctcaggcatggaggttgggtgtgtaagtatgcaggcacaacattgcctcgtgccgaattcttggcctcgagggccaaattccctatagtgag

SEQ ID NO: 422 - DNA, 207 bp, Rattus rattus
aaaaattcaaagtcttctttattgcaaaaaatatgtctttgacctgaggaaaggagttgtcttccaaaacctttgcgtaagggaaagggaaatcagcaccagtgacccaaaaagcaggcgcatcaaggaattttaatgcagggccttccaaaattcccgcaaaaatctcagccccgaccccaaattgggggcaacccccttccaaag

SEQ ID NO: 423 - DNA, 609 bp, Rattus rattus
  misc_feature (503)..(503): n is a, c, g, or t
  misc_feature (545)..(545): n is a, c, g, or t
acacgctcactgaggtcgctgagctcgcttctttctcttctccagagataagggcaagagatggaggaggtgattttcagttgtgtgtgggttggatttaaggctttggctctggttggctgatatactaaaatactttctgggaacaccacagagtccgcctggcaggccagcttcttcagcgaccgccggctgcactcattcagcgcctccaagctggccacatccaggatcttggagagtgactgcagcagctcctcgccctgcctcagtttgagcagattcacgatggcctgctcgctgtaggccctcactaccgtgttcttgtccttggtgttgtcgagtagagccttcaggatgggcttgatggcctggggctccaaggcaagccggggctccttgttggcccaccagatcatcttctcggcaaccagcctgatgtcactggacgggttctgcagacacttaatgagcaaggtggagagtctgggtggcagctgtcnccctcctgtctcgatgtgatacttcatgaggaaagccatgcnccgaatcccattcacggcaatggggatcctgtcctgcacaacgttgctgaggaccagtcctgaa

SEQ ID NO: 424 - DNA, 480 bp, Rattus rattus
  misc_feature (439)..(439): n is a, c, g, or t
tcttcaactttattttagctaagtcattttcagattctggaaaagtgacatttccaggttaaccttgagaatgttaggcaagcaagcaagtttagtaaagttgccttgcaggaatgagaacttctggtggtggagctcattggacttacagtgtacctagatgtaacatgactgaaaaattaaaactgattgcttctgtgtcttttgtgtgatcattagccttaatcatccaaggcagtgctgtctatctgaactacctttgagacagactctctgaaaggctggatccccatgttccagccaagtgttatgaaccagtcatctttattgtactcatacaggctaggtacatgcacactactagacaacactgccttccaccacccacgacagcatcgaatatgatccagatctctattttgttatcaagctttaccanaaatatacttaaatggactatagtaaaaaaagagtcactag

SEQ ID NO: 425 - DNA, 529 bp, Rattus norvegicus
  misc_feature (456)..(456): n is a, c, g, or t
tttttttttttttttttccctcccaaacagcttttaatagttttacttcagctggaagatgtagtcagagaataagttacaggaacagacaaaaacagaaaataagaaaacagaacttaaagtgcttcaggctgccaacgtaaacataaggggcacaaagaggcccacttagctatgtccccaacccctgagacaggagagtcattgtcattgtcgtgggtccctttaccactaccaccctctaatcttggccctgtaggtgggtgcaaaggaattttagcggcagagaggattggacacgaatgagagagaatactctgtaaactcgggacgacgtgaaggatcggggcgaaggagctcctgcagcctttgccctgctggggtggggccaggactttacactcacgcttggcaatcttgtctagagaaagcacagccttgtccgggggcaggtanaggggacgaccgacaggggaggccacagggggggtgatggccctgcgttccatcacactgcctgacctcatga

SEQ ID NO: 426 - DNA, 566 bp, Rattus norvegicus
tttttttttttttttttaaacagtgtggtcctatgttttcaaagtaaaaatagttctctatgaccaagtacttaaatataatttaatactcatctaaagcctttgcagcttcagaagtggagaaagttttagccgcgtatctttatatctcctggtttctcactgaattggcttgagttgcctatgctggcagaaggttgacattgggcgaccaattgctttgggctcatcagtgcgttgaattagttgttgaatggcgagagatttgctggggcagccctgtgaatgtgttctatgactgagcaacctccttagccttcaaaatagaatttttgatgttggaaattccatactaaaaggaagccttaagtaagaatagcttgttaattatgtcctcattaagtaatgttcatggctaatgtcacattgttaacagttgttactttggaattatatggcatgtggtttaaggcttagttaattctctagacttcaaaaactgtattattgatgtattataagaaattacagtaccactttgattagtctgaatgtttgcagacctt

SEQ ID NO: 427 - DNA, 347 bp, Rattus rattus
  misc_feature (14)..(14): n is a, c, g, or t
  misc_feature (200)..(200): n is a, c, g, or t
  misc_feature (249)..(249): n is a, c, g, or t
gggaaagggttctncattgcacatttaatagttcatgcagcacttggtgacataaataggggatgggggaacagggccacagaatccacagatagtccacagtgcaggcaagacacacatggccagggccacacagcagggagctgatggtcagctggaagggtcacctagacgtgcacagcggggcagacaaaggttgntcacactgtctcatgacatgctggtcatccagaggacactgagcagttntggacactcatgtggccctcgggcctggctggctcatatcacagtccactgttgatggtttagggatgtggggtcaagcctggtttcaatacattatc

SEQ ID NO: 428 - DNA, 591 bp, Rattus rattus
gggcctgaatactcactttattaacactttaaatacaggaaatagttccaagcagggccaagccctaggacaagggtcagagaaacaggaggacagacaactggatggacacacaccctaggatactctgcccccacagaggctgtagtcccaacaagtctcccaccagatacatacactgaggctcagagcccagagctgtctcccaccacaaaggcaggcctgtcctggtgagcataggtaggccagctcacagcaggcgcctgcaggggagctcatctccagcgactctgagataccagaggatagaatacgttgagcacaagggccaccaaagccgccacggtacccaggacaaagtatcggaggcagccctcgtctgatgtggtagggccacgtggcgggggccccacccagtcttggggcccccaaggacccagaggcccaggcccctcgggcaccatctcctcctcggcctcgagctcctgccaaatccgggaagcctatggtatgtggaaagggccatcagcacccagaggatggggaggcccagtttccctgagacccctagccaagacagtcacattaagg

SEQ ID NO: 429 - DNA, 421 bp, Rattus rattus
  misc_feature (369)..(369): n is a, c, g, or t
aaaaaaatcaatttattgtaaatagagacatgcactcatactctccgtgcttccaggcacccacagggaagtctggcagttgtgtgggttctccatagggtgggtaatgaggctgagagtccctggttaaagaactaagttagagcaaaccagctatggatatttggtgctgcctgaagtgcagctccttggcatggggtgcacgtctacaggctccacaggacacattcccactggatccaacataaaggaacctctggggtcgggggtacatgtgttcatcctgaaatccttccggctggccaagacctcaccctgacagctgtacaaggggttgctgctcttttccacttcatcaggggccaccanggccatgggcacaaggggaatgataagcagttcactggatgcctggtcattt

SEQ ID NO: 430 - DNA, 514 bp, Rattus norvegicus
ttaaaattattcaaagacaggtttttattgcaaatatttgctcaaaaactactatatacaacagaattttaacaggccttgaaaacatttaacattcaattaaacagtttcaaagaattcaaagtacattttaagaattaaaaatgcagcatttaaaataaaactttattagtacttaaaagcaaattattgttatattcacttctatatctaaaaaaatcaacttagtagctgacttacggataaattaggctaattcccaccccccctcttgtttttgaacatatgctttagggtcccattagaagtctctacttttacaattgaggacgtcccttaacatagttgagtacatgcgaaggcatgtttttagttcaattccttttgcctacattctaccatactttggtttggtttccagaccatttttatgggtctactgctaaaaatcattgaaacaatattaaaagcatagtagctatttaagagtttcaataacagatttctactttat

SEQ ID NO: 431 - DNA, 684 bp, Rattus rattus
ttcaaaacaatttattgcatcatatttggtaccttatgtttgacaacaaaaaagaaattacatttgtaactgcaggaaaaagaagctggtctgttattgaaaagaaaaatcttgggccctttaaaaattacaaagtcttgggcttgcctgaaacaactgagcaagaaatatattcttagaaatgaagggcttcaagtattacaaacctgtgacactgtggaaaagttccagaggtatctaaactgcagcactttttctgcatatcgtgaacaaggcctgctgaggtttttagctattagtctcttgatcagaatggtagtcaggagttctgctctttaacttcaagccatggtagagtttccttttttcactctcaggtgaaaaagtcatgcttgctaattagttggtgccacatcacagtgcatttggttcttgcattacagttttaacaagtttggccaaaacaatgctaaagctttgcattgttattttagttcttcaagttttagttaaattgagattgttccaactggttccttcggttaaaaactgtggtacaagaacaccaaactgatcatgtacagtgaattttggaaacacaacacacgtactgaacaccttctaggtttcatttaatctgcttggtagctatgtgtccaagttatctacaacgtcaagcatctg

SEQ ID NO: 432 - DNA, 560 bp, Rattus rattus
gaaagtgtctgcaagttttatttgtagactctgttaagcttgaaccataaaagctgcaaaacagtggtttagagagcatgtcaataccatgggggttggtgggtggaaactgttccttctgccagttcctaaggctggaagtggctagggcaggcagtggcgaggaaatagctggatgagctgaagcttgggtggcagtgcttactcaagcctgactcctgcctgtctcaggccctggggtcatatacacggcccatgaagactgggaacttgtgtcgctggtcccagagcaggaagaggaaaggctgctgcacctcaaagatgagtaagtttcgggccacggagatggtggaggctgcggctgcttccacacctgtctctgtcagttccaacaccgtctcgtgtttcatggaagacacctgaagatctgggtcctcagtcagcccacacaggttgagatcgtaagtgaagtcaaagaattccagtttctccatgattgacagcatgtcttggatgctctttactttaatgcgaggcatcatcacgtaagtgggctgaaa

SEQ ID NO: 433 - DNA, 479 bp, Rattus rattus
  misc_feature (435)..(435): n is a, c, g, or t
aagacaggatgtcagtccctgaaaataacatttactggttattgcctttaaaactgtggattttttttaagttacagaaaatccagttctgcaccacaatacaactgtaaaaaatctgcatcaccttaaaactgtgcagtaatgccattttataactgcataaattttattagcgttctaaacagttttgcgattttttttttgtattatatgcttgcaggttatatcttagtgcaattcagtcccaaatactttaattttggaaaaaaaacatacagtttgaatgtaaaatacccctacagatataagcaggggcgtttcccccttttaatactttggttttcaatacagtccacggtatagcaagaactacacatacccaacttatatttaagttgcaagcacatgcttcagaagctacttttaaaacagtcnccttgcaaactctaccccccttaacatcacaacagtaaacgatt

SEQ ID NO: 434 - DNA, 472 bp, Rattus rattus
caaagttgtgaacaacgtcaagaacacatttggctacttaattactattttaaggatggcgtgcagattcatagagtcagcattgtggttttcggggggagtataaagattctgcctctactttcctttacagtaaaactgtgacaaattaatgaaacaattatacccgctctaattgtatacggtggttcctggcctcttttgttctacaccccaccggctattgtatacatagtgagttttaagcttataaaaaatgtagtagaaattgctgttgtctaaataggtaaaactattcctttagtagcttgaaatattactacgtggttgaatacaaacctttctttagtactactttagtaacacttaaacatacacaaagtttaaggaacaagcttgtaaccagtaagtctatgtaaaattctgcattgcagactaaatacagcggatggcgtatagacatcagagaaaa

SEQ ID NO: 435 - DNA, 8048 bp, Rattus norvegicus
  misc_feature (2005)..(2005): n is a, c, g, or t
  misc_feature (3503)..(3503): n is a, c, g, or t
gaattcggcccaggataaacagatatataggtaaatgactggatagatacatggatttgatctctaactcaacttaggcaccatagaaaacaatccttgaattattttaataattttaaatcctagtttactgagaaacacgttgacgaggcagggcttcagcctctctgaagcagcactgcccctctgtggccacacaggaagtcttcactcagcagtttcctgacttaaggcctaggcctgaggaaatgcattgaatatttctctgggggacaatagttctgagaaggaaagagagtttgtctatgttgaggtcagttaaggatggttttctttccttccctcccagccttttctccatgcaacatcatgagtccccatctttctatcctgcctaaaaccacttccttctgggaaatgagaaaatccactcatacaaaatggaaacatcccgaggatcccggcccgcagcagctctctgcccccagaccctgtgagagagagacccaaccgcctggtcaggtgggcactcctgaggctgcagagggaagagaccaccaacactgctcacccctgcccacatccctggcccaagaggaaactgtataaggcctctgggtcctgtgggggagggcccaggagcggcaggacccctgtgcctgagagaccaccaccagaaccagaaggaaacagaccggataaacagttctctgcaccaaatcccgtggagggagagctgaaccttcagagagaaagacaagcctgggaaaccagaagagactgctctctgcacacacatctcggacgccagaggaaaaagccaaagaccatctggaaccctggtgcactgaagctcccggaaatggtgcacaggtcttcctggttgctgccgctgcagagagcccgtggtagcaccccacgagcgaacttgagcctcaggaccacaggtaagaccaacttttctgctgcaagaaagctgcctggtgaactcaagacacaggcccacaggaacagctgaagacctgtagagaggaaaaaccacacgccggaaagcagaacactctgtccccataactgactgaaagagaggaaaacaggtctacagcactcctgacacacaggcttataggacagtctagccactgtcagaaatagcagaacaaagtaacactagagataatctgatggcgaaaggcaagcgcaggaacccaagcaacagaaaccaagactacatggcaccatcggagcccaattctcccatcaaaacaaacatggaatatccaaacacaccagaaaagcaagatctagttccaaaatcatttttgatcatgatgctggaggacttcaagaaagacgtgaagaactccttagagaacaagtagaagcctacagagaggaatcgcaaaaatgcctgaaagaatcgcaaaaatccctgaaagaattccaagaaaacataaataaacaagtagaagcccatagagaggagacacaaaaatccctgaaagaattccaggaaaacataaataaacaagtagaagcccatagagaggagacacaaaaatccctgaaagaattccaggaaaacataaataaacaagtagaagcccatagagaggagacacaaaaatccctgaaaggaattccaggaaaacacaatcaaacagttgaaggaattaaaaatggaaatagaagcaatcaaaaaagaacacatggaaacaaccctggatatagaaaaccaaaagaagagacaaggagctgtagataaaagcttcaccaacagaatacaagagatggaagagagaatctcaggagcagaagattccatagaaatcattgactcaactgtcaaagataatgtaaagcggaaaaagctactggtccaaaacatacaggaaatccaggactcaatgagaagatcaaacctaaggataataggtatagaagagagtgaagactcccagctcaaaggaccagtaaatatcttcaacaaaaccatagaagaaancttccctaacctaaaaaaagagatacccatagacacacaagaagcctacagaactccaaatagattggaccagaaaagaaacacctcccgtcacataattgtcaaaacaccaaacgcacaaaataaagaaagaatattaaaaacagtaagggaaaaaggtcaagtaacatataaagggagacctatcagaatcacaccagacttctcgccagaaactatgaaggccagaagatcctggactgatgttatacagaccctaagagaacacaaatgccagcccaggttactgtatccagcaaaactctcaattaacattgatggagaaaccaagacattccatgacaaaaccaaatttacacaatatctttccacaaatccagcactacaaaggataataaatggtaaagcccaacataaggaggcaagctataccctagaagaagcaagaaactaatcgtcttggcaacaaaacaaagagaatgaaagcacacaaacataacctcacatccaaatatgaatataacgggaagcaataatcactattccttaatatctctcaacatcaatggcctcaactccccaataaaaagtcatagattaacaaactggatacacaacgaggaccctgcattctgctgcctacaggaaacacacctcagagacaaagacagacactacctcagagtgaaaggctggaaaacaaatttccaagcaaatggtcagaagaagcaagctggagtagccattctaatatcaaataaaatcaatttccaactaaaagtcatcaaaaaagataaggaaggacacttcatattcatcaaaggaaaaatccaccaagatgaactctcaatcctaaatatctatgccccaaatacaagggcacctacatacgtaaaagaaaccttactaaagctcaaagcacacattgcacctcacacaataatagtgggagatttcaacacaccactctcatcaatggacagatcatggaaacagaaattaaacagtgatgtcgacagcataagagaagtcatgagccaaatggacttaacggatatttttagaacattctatcctaaagcaaaaggatataccttcttctcagctcctcatggcactttctccaaaattgaccatataattggtcaaaaaacgggcctcaacaggtacagaaagatagaaataatcccatgcgtgctatcggaccaccacggcctaaaactggtcttcaataacaataagggaagaatgcccacatatacctggaaattgaacaatgctctactcaatgataacctggtcaaggaagaaataaagaaagaaattaaaaactttttagaatttaatgaaaatgaaggtacaacatacccaaacttatgggacacaatgaaagctgtgctaagaggaaaactcatagcgctgagtgcctgcaaaaagaaacaggaaagagcatatgtcagcagcttgacagcacacctaaaagctctagaacaaaaangaagcaaatacactgaggaggagtagaaggcaggaaataatcaaactcagagctgaaatcaaccaagtagaaacaaaaaggaccatagaaagaatcaacagaaccaaaagctggttctttgagaaaatcaacaagatagataaacccttagccagactaacgagaggacacagagagtgtgtccaaattaacaaaatcagaaatgaaaagggagacataactacagattcagaggaaattcaaaaaatcatcagatcttactataaaaacctatattcaataaaacttgaaaatcttcaggaaatggacaatttcctagacagataccacgtatcgaagttaaatcaggaacagataaaccagttaaacaaccccataactcctaaggaaatagaagcagtcattaaaggtctcccaaccaaaaagagtccaggtccagacgggtttagtgcagaattctatcaaaccttcatagaagacctcataccaatattatccaaactattccacaaaattgaaacagatggagcactaccgaattccttctacgaagccacaattactcttatacctaaaccacacaaagacacaacaaagaaagagaacttcagaccaatttcccttatgaatatcgatgcaaaaatactcaataaaattctggcaaacgaattcaagagcacatcaaaacaatcatccaccatgatcaagtaggcttcatcccaggcatgcagggatggtttaatatacggaaaaccatcaacgtgatccattatataaacaaactgaaagaacagaaccacatgatcatttcattagatgctgagaaagcatttgacaaaattcaacacccttcatgataagagtcccggaaagaataggaattcaaggcccatacctaaacatagtaaaagccatatacagcaaaccagttgctaacattaaactaaatggagagaaacttgaagcaatcccactaaaatcagggactagacaaggctgcccactctctccctacttattcaatatagttcttgaagttctagccagaccaatcagacaacaaaaggagatcaaggggatacagatcggaaaagaagaagtcaaaatatcactatttgcagatgacatgatagtatatttaagtgatcccaaaagttccaccagagaacgactaaagctgataaacaacttcagcaaagtggctgggtataaaattaactcaaataaatcagttgccttcctctatacaaaagagaaacaagccgagaaagaaattagggaaacgacacccttcataatagacccaaataatataaagtacctcggtgtgactttaaccaagcaagtaaaagatctgtacaataagaacttcaagacactgaggaaagaaattgaagaagacctcagaagatggaaagatctcccatgctcatggattggcaggattaatatagtaaaaatggccattttacccaaagcaatctacagattcaatgcaatccccatcaaaataccaatccaattcttcaaagagttagacagaacaatttgcaaattcatctggaataacaaaaaacccaggatagctaaagctatcctcaacaataaaaggacttcagggggaatcactatccctgaactcaagcagtattacagagcaatagtgataaaaactgcatggtgattggtacagagacagacagatagaccaatggaatagaactgaagacccagaaatgaacccacacacctatggtcacttgatttttgacaaaggagccaaaaccatccaatggaaaaaagatagcattttcagcaaatggtgctggttcaactggagggcaacatgtagaagaatgcagatcgatccatccttatcaccctgtacaaagcttaagtccaagtggatcaaggacctccacatcaaaccagacacactcaaactaatagaagaaaaactagggaagcatctggaacacatgagcactggaaaaaatttcctgaacaaaacaccaatggcttatgctctaagatcaagaatcgacaaatgggatctcataaaactgcaaagcttctgtaaggcaaaggacactgtggttaggacaaaacggcaaccaacagattgggaaaagatctttaccaatcctacaacagatagaggccttatatccaaaatatacaaagaactcaagaagttagaccgcaggaaacaaataaccctattaaaaatggggttcagagctaaacaaaaattcacagctgaggaatgccgaatggctgagaaacacctaaagaaatgttcaacatctttagtcataagggaaatgcaaatcaaaacaaccctgagatttcacctcacagtagtgagaatggctaagatcaaaaactcaggtgacagcagatgctggcgaggatgtggagaaagaggaacactcctccattgttggtgggattgcagactggtaaaaccattctggaaatcagtctggaggttcctcagaaaattggacattgaactgcctgaggatccagctatacctctcttgggcatatacccaaaagatgcctcaacatataaaagagacacgtgctccactatgttcattgccgccatatttataatagccagaaactggaaagaacccagatgcccttcaacagaggaatggatacagaaaatgtggtacatctacacaatggaatattactcagctatcaaaaacaacgagtttatgaaattcgtaggcaaatggttggaactggaaaatatcatcctgagtgagctaacccactcacagaaagacatacatggtatgcactcattgataagtggctattagcccaaatgcttgaattaccctagatccctagaacaaacgaaactcaagacggatgatcaaaatgtgaatgcttcactccttctttaaatgaggaaaaagaatacccttggctgggaagggagaggcaaagattaaaacagagactgaaggaacacccattcagagcctgccccacaggtggcccatacatatacagccacccaattggacaagatggatgaagcaaagaagtgcagactgacaggagccggatgtagatcgctcctgagagacacagccagaatacagcaaatacagaggcgaatgccagcagcaaaccactgaactgagaataggtcccccgttgaaggaatcagagaaagaactggaagagcttgaaggggctcaagaccccaaaagtacaacaatgtcaagcaaccagagcttccagggactaagccactacctaaatactatacatggactgaccctggactctgaccccataggtagcaatgaatatcctagtaagagcaccagtggaaggggaagccctgggtcctgctaagactggacccccagtgaactagactatggggggagggcggcaatggggggagggttgggagggggacacccataaggaaggggaggggggagggggatgtttacccggaaaccgaaagggaataacacttaaattatataagaaatactcaagttaattaaaaataataataataataataaaaagaattactcataaaataaagacaagatgatggataaaattaaaaaaacaaaaaaaacaaaaaaaaaccaaaatggaaacatgaaaatgctcactacttacaatagtgctttatgtaataagcaaatgactgcatttgacacgagttataatttattaaccccttagttagactacttgtacacatggtgattattaatccacaattattctttttcactaaaatccttatattttattctttgagattataatataatcacacaaattccctcttccctgtcatctcttcaaaaccttccatatagtcctccatgctgtcttttgaacgttatggcttcttttttatattcttgttttatattatatatatataatatatattataatatatatcatactatatatattcctcaggactgaccaatccatattggataaccaattggtgtgctcgtctcagggaaagaccatttccccaccatcagcattctcggtttccagtagttcattgtctagaatggagactgtgtgtgctttccccgtccactttagctgctgtgtttcagctcctcttgaggcagttatgttggtgagacctcatctgtgcggcttccaacattcctcagagacacagtgagttacacagtgtcacctgatcctctaactcccaccatctttcctgctgtcttctccagggtttcctgaacctcagcaggagcaggggttgtactgtagacacgcccaccttcactaggatccacagctcctcactttgatttgctgtggttttctgcaatggcttccatgtcctagtaaagtcatggagaccccataaccacgctgtactaaaccagacaatccctagctgcattctaagttcttgtccttatcccatacatgtgcatttagagagtctgcttattttgctcattatagaacgagtcaatcattctctttgagttgtaaaagctt

SEQ ID NO: 436 - DNA, 616 bp, Rattus rattus
actctgaataaggttgatatttaaagagcagaggaaatgcctatacaaaaggtttatggaacattcatttacatactggatatatattctttacaatatagaatagtgaaaactgcgctaatgggtaagacaggtacaacaacattacaacgtccttgacactgaggataaatgcagtgtggcttttaacgtgggaacagcccaacactggaaactatgagaccattaatgagaaggttaatgggaccctggttatatatggaaagtggagggacatcactgaatttactcaccgaacaatgcactaacttctgcccaactgatggccttgaagcaaaagcctgagcaacactcctcctcagtgtttctgagtatagtctatgacactggtctcgtcttgttctcttcaatacaaacgtcacacacagaagacagaagtttgccctaccagctgttgtagacagttgtagagctgtcttcctgtgtttcctcagagtgaatcccttgacacccttgactacttttaccttgagtgaagatcatacctggtcagccacttgaaaacgcattcccatggcttcttggatgccaacctctgtggcattcaattcactgg

SEQ ID NO: 437 - DNA, 663 bp, Rattus rattus
gtaattccacaccagtttatttcttaggtgtgatcgtgacacagtgccttctgtgacaaggtggggctttcaggagggcactgaaccccctcctcagagcagctcacctcagaaaacacccgaggcagatttgattacgaataccccccaggccaccaatatttacatgggaaagtggaactgagtagaggaattatgacacaagaaagtggggtgtcctgaagatgctggggggcatgaaggcaccatcaaaagtctggatctccttctcagcgcggggctctgccctctagggccgtccttccgggtaggtggatccagggagaggagtgtagctggaggagtgagacttgcgccatctgaagaagccaagacagaagatgatgaagcccaggcccagggtggctgcagacacagagaccttcactgtctggatgggggacagcccgggtgtccagttcgcgcggatgggctcaggggtcccgctgtgctgtaccacgcaggtgtagatgtcccagtaggaaggggttaaggctaggtaggagacggtctggtatgtccagtccccgttaggctgagccgtcttctccttgttgctgtgggaagttacaagctgcccgttcttcatccacacgacggtcacatccgctggatagaaacccc

SEQ ID NO: 438 - DNA, 411 bp, Rattus norvegicus
ttaataatgaaagatgcatatttatttctacaaaagcaatgtatgatacagaacataaaggaacaattaaagatttacctattaaaatatacagattctgactgaaaagtaatagggtatttaaaaaagatgacaaaggatgttaatctttttttattattatcatttttacatattttggaacctcacataattttgataaataactcttacaaaattatgcaaaaagtacaagaatgtctggtaaacaaacagtctgtattttccaaaaagaatttttacaacatgcaattcttaaggcagcatcctctttacaaggtaatccttttactcatcaaatcttctgctgcaaagaataggctaagcaagcctggcttcttccattaacgccttttgtctttcctgtctgat

SEQ ID NO: 439 - DNA, 551 bp, Rattus norvegicus
tttttttttttttttttccacttcttaaatttttatttatttttttaaaatttacttgtttctgcataactttgagtgatgttacatgcttatacaggatgctggggccagtagtagccaaataaaggcatcaagacatgggtggaaactggaatttccagaggttgtaagcagccatgtgggtggtgggaaatgtccctgtgtcctttgcaagatcagcaacttttcctagtatctgtccttctctccagcattcttacacattgattcagttctaccaggctgtaagttattggctataagttatgagtatcagcggcatagcaaaggctatatggcatcattagacataacctgcaaaagggcacaaatgcattcaggatagggagagctgaatgcaggcatcataagatcaggctggcaggaagaaagtatcctcatcttggaacatggtttccccctacttgcccatcctgacagagctttggattggtggagatactgaagagaggactctccccatgtagtaaatgtgtctttatggagatgag

SEQ ID NO: 440 - DNA, 502 bp, Rattus rattus
cttgtagagtcttttatttgtttgtttgaaacagggtctcaaccactgtaacccctggatggcctggaactcactatttagaccaagttgaccgctaacatagaaataggcctccgagtactgggattaaagcggtgaagcacaatgttcagctcggaagtttgctaggggaatggggagcatgaatggaatggatgtcgaggcacctaaaatacattttttttctagacagtaacaagaatttggacgcaatagtgagatagtgaaaatcgggcttcttgtacattgaagcagggggcttgaagagttgtggccgagggacacgttttccctagcagagaccgtgttctttcctcaaactgcctctagatggtggtgctgttctggatgcagtccagtggataaggcttggcacagtgcacaaaacccctgcactgtagcagctgttgtaggcacggtcaggatcagaagcatacttttgatacaccggaatacagtctcc

SEQ ID NO: 441 - DNA, 501 bp, Rattus norvegicus
tttttttttttttttttagctgtcagcagggctttattgagcatctgcaaggtacacagcactgtacacagttatggtcaacatggtttgcctcgccctctgtaaaggtgtccttcgtcttcctgatcgtatatcctcagtgtgctgcttgccatgatacgccacagcagggatggtatcgtacgttttccccatcatactggagactccttatagatggaggattttccacctctgcaagcttgacacacgtctgccggacagatgaatgtatgaagaacagaggatgcttcctttgggttcctttcgttccctagtttgcattaggagggaaaggcactaagggaaggggatgtgcctgagaaaatggctgacacaggctaggaaaacagctccatgaatgacaaagttggccaacttccccaagggcctgagaacagaatgaagccacagcaaaatctccaagctaaagacagggttcagcttcctaaacccccacgt

SEQ ID NO: 442 - DNA, 1121 bp, Rattus norvegicus
aagatgaactctcaatcctaaatatctatgccccaaatacaagggcacctacatacgtaaaagaaaccttactaaagctcaaagcacacattgcacctcacacaataataatgggagatttcaacacaccactctcatcaatggacagatcatggaaacagatattaagcaatgatgtcgacagactaagagaagccatgagccaaatgggcttaacggatatttatagaacattctatcctaaagcaaaaggatataccttcttctcagctcctcatggtactttctccaaaattgaccatataattggtcaaaaaacgggcctcaacaggtacagaaagatagaaataatcccatgcgtgctatcggaccaccacggcctaaaactggtcttcaataacaataagggaagaatgcccacatagacgtggaaattgaacaatgctatactcaatgataacctggtcaaggaagaaataaagaaagaaattaaaaactttttagaatttaatgaaaatgaagatacaacatacccaaacttatgggacacaatgaaagctgtgctaagaggaaaactcatagcgctgagtgcctgcagaaagaaacaggaaagagcatatgtcagcagcttgacagcacacctaaaagctctagaacaaaaagaagcaaatacacccaggaggagtagaaggcaggaaataatcaaactcagagctgaaataaaccaagtagaaacaaaaagtaccatagaaagaatcaacagaaccaaaagttggttctttgagaaaatcaacaagatagataaacccttagccacactaacgagaggacacagagagtgcgtccaaattaacaaaatcagaaatgaaaagggagacataactacagattcagaggaaattcaaaaaatcatcagatcttactataaaaacctatattcaaaaaaacttgaaaattttcaggaaatggacaatttcctagacagataccaggtattgaagttaaatcaggaacagataaaccagttaaacaaccccataactcctaaggaaatagaagcagtcattaaaggtctcccaaccaaaaagagcccaggtccagacgggtttagtgcagaattc

SEQ ID NO: 443 - DNA, 439 bp, Rattus rattus
acagctattaggtgctgtccacttttctgcacagaccctgaaccatgcatcaacttattttctctgcaacttacaataactctctcagtgacttagcttaacccttcaagtttctgtaactttctcttcatatcttttctttatcttagccagattggtggggcattttccagcccctaggagacccacccttggagcctgggggcagacctggagcactccctaccttcaggggtatgaagagagcaggcagaagtgagggccttctatgcgtgttggaaccctttttttttctggcctctagtaggattccgtctttcctcggtggtaaagaagacctgtaacagttactaacaagcatatcaaatgggatggtgagaaaacaagagaatcttgagaatagagtctaccgaagagggcatacagcatttagtcacac

SEQ ID NO: 444 - DNA, 424 bp, Rattus rattus
  misc_feature (284)..(284): n is a, c, g, or t
  misc_feature (288)..(288): n is a, c, g, or t
cagagctggggaccgaacccagggccttgtgcttgctaggcaagagctctaccactgagctaaatccccaacccccaaaacactatgttttaaaaattaactttggctatcaaccaacacaccgccactagagcggggtccacaaaattaagtttcttactcactaagcgttaaggggaccaagtaaaactcttcgacgaacaaagcaaacagtttcatgatttcaaacacagtcgccggtccaagattttaaacacagtcgtcagtccaaattcaaacacganacanaagtcaaaaagacactaagagacacaacacgtccagaaaaccacagtcaggtcacaaagaagacaaacaattccaacagtcaaacaagtaacaagcagatgtgccgcgcggcttcggtaccaaactgaaaccaaaa

SEQ ID NO: 445 - DNA, 637 bp, Rattus rattus
ggaacaccagcaaatccggtactttattaagacatcttaggcttccctgcattttcaaaaacaggaatgctctattgactgaacacatcaaagggtctctgcagagtccttgggggccagccacaggaggtgtcatgtgattctgcagtcccagagcatggcagctagtgcttgcaatcacaggaagcaggcagtcggttctccatctgcctaggggagggtatccttcattcttttgaaggactgccttcaagtcacagctcaattccagtgtgtagactcggtctctaggactggggacaaaggcagctgccaggtgcaacagtttatgaggctccgccttttatatatgccacgggagcccgggctctgggagccagaagcccaagctggaccaaccgctgctgtgggctgatggccttagcagccacataatcttccctttgatgtccagggtcaatgcagtcctggccccaccagggctaggagaaggtgtatgaaagagaatctcactgtgatctgtcctgtgaaggaaacagcaataaaatttattacccagtcaccacagtcattctgacaggagttctcctagcctctgacctccacttgagagggaactttcagggaggacagggac

SEQ ID NO: 446 - DNA, 490 bp, Rattus norvegicus
ttggaaagagaacatcaggtttaataccttataaaatatgtacaaaacttgagcattcctgtgaaatacaattcaagtcataattgtaaatgtaattggatcctctgatacaatggaaaggtctagtgggttatcaaaaaagcatgtaaactacgaaagataaaaaggcactttaaccccagatttaaaatcatctctcaagtgtaaatatatatttgcaattcttaaattccacatactcgttaattttatatgatcttaagtgttaggaaaaaatgtaaaataatcctattcatttgttaaagtcaatataggaagaagagtggtagggaaggtggccgatagaatgtatcctacgcaggagtggaaactcgaaaggcaggcatgctgtaatttgaagagtaataaaacagacttagccaaaactgcctttgtgaaaaaggcagtctcagtttggagatgtcaccccaaggacccattttcttacagg

SEQ ID NO: 447 - DNA, 555 bp, Rattus rattus
ccagggacctccgtagtcggtctccctatcccactcccaaacctcagagcaggaaatgggcttggctgagaagattcatgcttgatgaccaggggaggcgtgcagccccccaagaagaaggggaaaagaaaaacggggaggttgaaaagcagagaggtgcaccttcccttctgaggaagcaattctggtctgggaccagttgcaaggggttagtaagagaaacctaaggggtgcttacatttttattctggcaaatgaatctcttaaaaggctccctcctaggggtgcttacatttttattctggcaaatgaatctcttaaaaggctccctccttcgttcgggggaacagcacatgtacctgtgtcagcgtgagatgcaatgctacacaagaacgtggcattgggccaatcatgtggacccctgtgctgctcccaagggagaggttctgtttgggtgtgggataaatctaaacaagcatacactcgtgttatatgtggccttaagggtaggggagcaaaaggaatggacttctctgtagagcagctcaagaggga

SEQ ID NO: 448 - DNA, 481 bp, Rattus norvegicus
ttcacttagatactgatttaattcatggatcaaggccatattttcaaagtattttaaggatgccagtacactgcaaaagctggagaagagttgagaaacagtatatgcttactaaacaagaactatctttatttatctagtgaatacctagagtaataaatttttacttcatgatagcaatcaggctcgcaaacacccagaaatagaatttaagggttttaaatgtagttataaaggtcataaaaagtctgattagactgaggtacatttactcaaaatgttgagattcattaagtggtagaaacaaaataatccctcaaaccaacccatattctcagtgtacatataattggaaaggagggggtgcattaattggtgagattcaccaagctgcatatcaatattttgttacatcaagtagtttgaagacaagggaaatgttctaatatataattttagattatgtattgtttggctaaaa

SEQ ID NO: 449 - DNA, 412 bp, Rattus norvegicus
tttttttttttttttttcatacatataacgactttattttgtttggcaacgggaaaacaagtcatgcaccatctctactcaaacactttcaaagccaagcaaatgatatatgaattagttttgctatcttctttcttccttttttctttaacatttgaacagtatagtaacagataaggtagttacagggaaatgtacagaattttatagtttgattaccttggcaattatgctgtgaaaccttcctttcattaaataattagttcagtgattctcaacctctgggttgaactcgaaacccctttcacaggggccgcataacggattatcagctatttacatcatgattaataatagcaaaattatagttatgaagtagtaaataattttatggtggggtcaccacaatgtg

SEQ ID NO: 450 - DNA, 615 bp, Rattus rattus
ccacatgtgcaaaagtttcccagagagttgggccccacaatgtgtaaaaaagacccccaatggggcagagctgtgtaaccataaaaaaaaaatagtaagagaaatcagtttcccaggaggcctggcttgggtggagcatgtcactcagggccagtccgcatgcggtgtgctgtttgttctggaactgctttcttctgattgttctttcttttccaagccccttactctagggctatggccaccagacggcctgacagagtcctcaggcatggtggtttgtgaggatgacttctttcacacacagataccccaactcagtgcttgcccactggcatcagccccactatgatccccagggcttccccccaacccgtttaaccccttatatcacagtctcggcccccagcttcaccaagtcttccctcaggacacctttgagggacactgaaacaaaacagataaaggcccggccccccacccaccaagtggcacagtggggtacgggggattgtatcaccccgtcacacctaaggcaggtgttttagtgtctgattctgtgagtgtggataggggggtggcacatctgtgtgggtatgactttggcaggaagtgggg

SEQ ID NO: 451 - DNA, 605 bp, Rattus rattus
cctataataactgtgatgatttattccatcatagagattaagatcacatgtatgttacatacaatacagaataatgtgtatgatgactatataatacccctgtacatatatttctgtatctgtacatacaaccagcaaagagaaaatctacatctgtgacctaagacacagaattcacaccctgcttctccagccaggctaacagtgagatcacagtcagtttcctgagtgctggggccaggttagagtccctgtaaccaacacatacaaccttagaagagctttaagaaaacacgcttgctttctcacagtcaacctactggagcgggatctgtgctataaacgtgacctcaagaattatttctgaatacccatgtacatcataaggatgggaaacaaagcctctgatttcattgcagacctttcctgtgagtccatggaaccacgttaacaaaagaacgagcaggcagaaggggagtcttagcagaacttggttcacccccaatcccactgccgtgagacttctcagttcaacctatccttacccacaccatataaagtaaacccaccttttacatttaagtgatgctttttcataaagtacc

SEQ ID NO: 452 - DNA, 2040 bp, Rattus norvegicus
aaaattcataaatacaatagttaaggatgttttagagacagagtttgctgcaagggtaagaacacacactactcagagtgaggacctggaactcttatacctaagcctgtaccatagccaccctgagtaggtatggctatcatctctgaagcctcaccctgcagaggcacaccctcacattggtaatctgctcacacaggacagagtgatcagggggcagaatttggcatataaaacagaacagaaccagttgcttcttatatttgcttctgatactgttgtgttgactcgcaacctcaggaacagacaccatggtgcacctaactgatgctgagaaggctactgttaatggcctgtggggaaaggtgaaccctgttgaaattggcgctgagtcccttgccaggttggtatccaggttacaaggtagctcctaagtagaagtttggtgcttggagacagagatctgctttccagcaggtactaacttttattgtctcctggctatgtttccctttgtagtctgctgattgtctacccttggacccagaggtacttttctaaatttggggacctgtcctctgtctctgctatcatgggtaacccccaggtgaaggcccatggcgaaaaggtgataaacgccttcgatgatggcctgaaacacttggacaacctcaagggcacctttgccagcctcagtgaactccactgtgacaagctgcatgtggatcctgagaacttcagggtgagtctgatgggctccccctgggtgtccttcctatgctttcctgctcaccttcctatcagaaggaaagaggaagccactctagggagcattttttgatgaaggtgtgtgggtgtgccctgtggagtgttgacaggagtccagttattttatcctctactcacaatcacttctcccgctcactctgttctatgttatcatttcgtctttcttgagtaaacttttaatttttagttgcagtttttttcttttttaaaaaaattaattaactgacttatttactttccatcccgatctcagcttcccctcctcctctcttacctcctctttctattaccctacctctttcttttctcctcattccatttttgtcttttttaatctactttttgttttcttttaagtatttcctagtaacttgctctgaggacaaggaagacatgtgagtccctgtttcttcccacagctctaaagaatagtagcagctattggctttcatggcagggtggaagggctgcattattttacatataaattctgtttgacatagcagaattcttgttataatttttcagtactttaagttggaaacaaaaacgccatttgaaatgagcctgaagtgtctggtatttttgctctgcaattatgttgatggttcttccctcttcccacagctcctgggcaatatgattgtgattatgatgggccaccacctgggcaaggaattcaccccgagtgcacaggctgccttccagaaggtggtggctggagtggccagtgccctggctcacaagtaccactaaacctcttttcctgctcttgtctttgtgcaatggtcaattgttcccaagagagcttctgtcagttgttgtcaaaatgacaaagacctttgaaaatctgtcctactaattaaaggcatttactttcactgcaatgaaatatagtgttaaatgtgttaaattaattgtgtctcacagaagggttcatgctaaggtttcaagatacaaagcagtgagggttcagttctgaccttggggaaataaatgatttgtgcttcatgatatatgctgggacagtaagctataaggcacagctcctaatcctcccctctgaacacctaagagaaaattcaagacatggtttcatttacacactagattttggttacattttatgttaattacttgttttctctagttttcctcataaatgtgtcctgtcttttctcttacctacccagcacctcacagatttgtagtcaataattattctttcctaaaattaccactattctctaa

SEQ ID NO: 453 - DNA, 424 bp, Rattus norvegicus
agccagcgaagtacatggagtttgatctgaatggcaatggagatatcgatattatgtccttgaagcgaatgctggagaaacttggggttcccaagacccatctagagctgaagaaattaattagagaggtgtccagtggctccgaggagacgttcagttactctgactttctcagaatgatgctgggcaagagatctgccatcttgagaatgattctgatgtatgaggagaaaaacaaagaacaacagaagccaactggtcccccagccaagaaagctatttctgagttggcctaatggaggtggatataacacggtgggaccgaggaccttcgtgtcagcagcatgggaagagaagaatcagttgcgagccagactgtcaatgctcaataaataatgctccctagtgcctgaaaaaaaaaaaa

SEQ ID NO: 454 - DNA, 393 bp, Rattus norvegicus
gacacaccttgccgatggctgaacatgtgcaattcgtgagggacacgctcacttctagccttaagggggtaggagtgatgtttcaggggaggctttagagcacgatgaggaagagggctgagctgagctttggttctccagaatgtaagaagaaaaaatttaaaacaaaaatctgaactctcaaaagtctatttttttaactgaaaatgtagatttatccatgttcgggagttggaatgctgcggttacctactgagtaggcggtgacttttgtatgctatgaacatgaagttcattattttgtggttttattttacttcgtacttgtgtttgcttaaacaaagtgacttgtttggcttataaacacattgaatgcgctttactgcccatggg

SEQ ID NO: 455 - DNA, 689 bp, Rattus rattus
cggttagccatcatggacatagccatccaccacccctggatccggcgtcccttctttcctttccactccccaagccgcctctttgaccagttcttcggagagcacctgttggagtctgacctcttttctacagccacttccctgagccccttctaccttcggccaccctccttcctgcgggcacctagctggattgacactgggctctcagagatgcgtatggagaaggacaggttctctgtgaacctggacgtgaagcacttctctccagaggaactcaaagtcaaggttctgggagacgtgattgaggtgcacggcaagcacgaagagcgccaggacgaacatggcttcatctccagggagttccacaggaagtaccggatcccagccgacgtggatcctctcaccattacttcttccctgtcatcggatggagtcctcactgtgaatggaccaaggaaacaggcctctggccctgagcgcaccattcccatcacccgtgaagagaagcctgctgtcactgcagcccctaagaagtagattccctttcctcgttgcattttttaagacaaggaagtttcccatcagcgaatgaacatctgtgactagtgccgaagcttactaatgctaagggctggcccagattattaagctaataaaaaatatcgttcagcaaaaaaaaaaaaaaa

SEQ ID NO: 456 - DNA, 635 bp, Rattus norvegicus
aatgtcatttatgttgtccttggagccatctctgctgtggccatcattggagctgtgatcattggaggtgtgttggctgttgtgaggaagagaaacacaggtgggaaaggagactacacccctgctccagatagggacagctgccagagctctaatgtgtctctcccagattgtaaagcatgaagacagctgcctggagtggactgagtgacagacgatgtgttcaggtctctcctgtgacatccagagccctcagttctctttagacaccagtgtctgaagttccctgtgattctatggcttcagtgtgaaggactgtggagcccagcctgccctgcacacctggaccctgtccctgaactgcctgtcttcccttccacagccaaccttgctggtccagcctggggttgggggctggggacagctgcatcctgttactctgtgctgccctgagctgcagctcctcacttctacactgagaataagaatctgagtgtgaaattgactgttcacatccttgacacagtgttgattgctttttaaattactagattgagaatacttagaggttgttttttgtttttatttttgttttgttttgttttaaataaatggcaggcggagaaccttccaga

SEQ ID NO: 457 - DNA, 2129 bp, Rattus norvegicus
ttggaaatgtgaacgcaagaagcaggcttgatttttttttcctcccccctctcctagctctctcctcctctctctccctctcgcacccacactcacgcacacctccagcccgcacacagacgtgcacgcaccccccgccgcccggcagttatgtattctccgctctgtctcacccaggatgagtttcatcctttcattgaagcacttctgccccatgtccgcgccttcgcctacacatggttcaacctgcaggcccgaaagcggaaatacttcaaaaagcatgagaagcgcatgtcgaaagaagaggagagggctgtgaaggatgaactgctaagtgagaagcctgaggtcaagcaaaagtgggcttcccgacttctggccaagttacggaaagatatccgacccgagtaccgagaggattttgttcttacagttacagggaaaaaacctccatgctgtgttctttccaacccagaccagaaaggcaagatgcggagaattgactgcctccgccaggcagataaagtatggaggttggacctcgtcatggtgatcttgttcaaaggtattccgctggaaagtactgatggtgaacgccttgtgaagtccccacagtgctcgaatccagggctctgtgtccagccccatcacataggggtttctgtaaaggaactcgatttatatttggcatactttgtacatgcagcaggacatttgggcttccaggacagcttcgtcacatcaggtgttttcagtgtgactgagctagtaagagtgtcacaaacaccaatagctgcaggaaccggccccaatttttctctctctgatttggaaagttcctcatactacagcatgagtccaggagcaatgaggaggtctctacccagcacatcctctaccagctctaccaagcgcctcaagtctgtggaggacgaaatggacagtcctggtgaagaaccattttacacaggccaagggcgctccccagggagtggcagccagtccagcggatggcatgaagtagagccaggcatgccatctccaaccactctgaagaagtctgagaagtctggtttcagcagcccctccccttcgcagacctcctccctcggaacagcattcacacagcatcaccgacctgtcataacaggaccgagagcaagcccacatgcgacgccatcgactctccactttccaacgtcacctatcatccagcagcctgggccttatttctcacacccagccatccgttaccaccctcaggagacgctgaaggagtttgtccaacttgtctgccccgatgctggtcagcaagctggacaggtggggttcctcaatcccaatggaagcagtcaaggcaaggtgcacaacccattcctccccaccccaatgttgccgccgccaccgccaccaccgatggccaggcctgtgcctctgcccatgccagacaccaagcctccaaccacatcaacagaaggcggtgcagcctcccccacctcaccgacctactcgacacccagcacctcccccgcaaaccgattcgtcagtgttggaccacgggatccaagctttgtaaatatccctcaacagacacagtcctggtacctgggataaaagttgcagcgtcccaccatcctccagacagaccacctgaccccttctcaactctgtaacatggacgcaacctcaacccggcgcagttacaacttcactgtcagtggaaggggagagacaccaactcgaatcaacttgtacatggaaacagcgaacgtcgtggtcaaacagcaaaggccataacttttcgggattctttttttttttttaatactttagggactgtcgtaatttctcatatggtgctggaaatggttgggctgtgtgacatttgaagtgttccagtggtggtgtgagcagtaggtgaagcggctggtaggggatgagccttgctcacgaacttcctgttgtaacacttgtgagcctggccttttcacagtatttcaagaatttgcccgcgcaggtgtgtgaccctcccggagcacttggagacacctggagaatgaaatctttcgtagtagctaagatctgtgatctgtaacttacaggacactcaaagggcaatgttttttggg

SEQ ID NO: 458 - DNA, 570 bp, Rattus rattus
tttttatttttttttgcagtgaaagtaaatgccttttattagtaggacagattttcaaaggtctttgtcattttgacaacaactgacagatgctctcttgggaacaattgaccattgcacaaagacaagagcaggaaaagaggtttagtggtacttgtgagccagggcactggccactccagccaccaccttctggaaggcagcctgtgcacagggggtgaattccttgcccaggtggtggcccaacacaatcacaatcatattgcccaggagcctgaagttctcaggatccacatgcagcttgtcacagtggagttcactcagatgagcaaaggtgcccttgaggttgtccaagtgtttcaggccatcattgaaggcgtttatcaccttcttgccatgggccttcaccttagggttacccatgatagcagaggcagaggacaggtccccaaagctatcaaagtacctctgggtccaagggtagacaaccagcagcctgcccagggcctcgccaccaacatcatcagggttcacctttccccacaggccattaacagcagccttctcagc

SEQ ID NO: 459 - DNA, 497 bp, Rattus rattus
ttttttttaacattttatattgatgaatagtaaaagcaatctgaacatatgagatcttgttcataaataattcttcattattgatttttttatagtaaaacaaaagagcggcaacgagcctggtactgtctatggctatcacaatagaaggctcctcactttgcacgcaacagtgtacaagcatcgatatacacatttcctagtaatttcgacttttacgtggtaaaaaaaaaatggtcctgctctaaaacttgtactttgcgcagtgcagaatttgaacttgatcacttctaaactagaaattaatgtgatgtgttagacgtgtgacagaggtacggtcaagatgagtctcaaacgaaatgctaacgattgggcattgaatgtgttctattggtgaaaatgactaagaaaaatctgataataaaattatgattatcaagctccccacactcaagaagccaatgcaggatggttgagagttcaaggtaagcctgaag

SEQ ID NO: 460 - DNA, 824 bp, Rattus norvegicus
cgatggaaccttccaaaagtgggcatctgtggtggtgcctcttgggaaggagcagaattacacatgccttgtggagcatgaggggctgcctgagccgcttacccagagatgggagccttctccatcgaccgactccaacatggaaacctatgtcatttatgtcatccttggagctgtggccatcattgcagctgtgatcattgtagctgtggtggctgttgtgatgaagaggaggagaaacacaggtggaaaagtaggagtctacgcccctgctccaagcagggacagctctgagagctctgatgtgtctctctcagattgtaaagcatgaagacagctgcctggagtggactgagtgacagacgatgtgttcaggtctctcctgtgacatccagagtcctcagttctctttagacaccagtgtctgatgttccctgtgattctatggcttctgtgtgaagaactgtggagcccagcctgccctgcacacctggaccctgtccctgcactgcctgtgttcccttccacagccaacctcgctggtctagcctggggttgggggctggggacatctgcaccctatcactcagtgctgcttctagctgcaactcctcacttctacactgagaataagaatctgagtgtggggctggagagatggctcagcggttaagagcacccgactgctcttctagaggtcatgagttcaattcccagcaaccgcatggtggctcacaaccatctataaatagatccgatgccctcttctggtgtatctgaagacagctacagtgtacttatatataataaactaaataaatctc

SEQ ID NO: 461 - DNA, 1590 bp, Rattus norvegicus
ggatctcagatggaggcgatggcaccgcgcacgctgctcctgctgctggcggccgccctggccccgacccagacccgcgcgggctcacactcgctgcggtatttctacaccgccgtgtcccggcccggcctcggggagccccggttcatcgctgtcggctacgtggacgacacggagttcgtgcgcttcgacagcgacgcggagaatccgaggatggagccgcgggcgcggtggatggagcgggaggggccggagtattgggagcagcagacacggatcgccaaggaatgggagcagatttaccgagtggacctgaggaccctgcgcggctactacaaccagagcgagggcggctctcacaccatccaggagatgtatggctgtgacgtggggtcggacgggagcctcctccgcggatataggcaggacgcctacgatggccgcgattacatcgccctgaacgaagacctgaagacgtggacggcggcggactttgcggcacagatcacccggaacaagtgggagcgggctcgttatgcagagagactcagggcctacctggagggcacgtgtgtggagtggctcagcagatacctggagctcgggaaggagacactgctgcgctcagatcccccagaggcacatgtgacccttcaccccagacctgaaggtgatgtcaccctgaggtgctgggccctgggcttctaccctgctgacatcaccctgacctggcagttgaatggggaggacctgacccaggacatggagcttgtggagaccaggcctgcaggggatggaaccttccagaagtgggcatctgtggtggtgcctcttgggaaggagcagaattacacatgccgtgtggagcatgaggggctgcctaagccactttcccagagatgggaaccttctccatcgactgactccaacatggaaaccactgtcatttatgtcatccttggagctgtggccatgattggagctgtggccatcataggagctatggtggctgttgtgaggaggaggaagagaaacacaggtgggaaaggaggagactacgcccctgctccaggcagggacagctcccagagctccgatgtgtctctcccagattgtaaagcatgaagacagctgcctggagtggactgagtgacagacgatgtgttcaggtctctcctgtgacatccagagccctcagttctctttagacaccagtgtctgaagttccctgtgattctatggcttcagtgtgaagaactgtggagcccagcctgccctgcacttcaggaccctgtcccttcactgcccgctttcccttccacattcagccttgctggtccagcctgggggtggagggtggggacatctgcatcctgtccccctgtgctaccctgagcttcagcccctcacttccaccctgagaataagaatctgagtgtgaacttgattgttcacatccttgacacaagtgtagatggctttttaaattactggattgagaatacttagaggttttttgttttgggttttgctttgtttgattttgtttttgaaaaaaataaatggcagatggagaagcttccaaaaaaa

What is claimed is:

1. A method of screening a test agent for treatment of aging-dependent cognitive function decline comprising:
   (1) measuring the expression of a plurality of aging- and cognitive-related genes (ACGs) in a mammal to obtain a pre-test agent-ACG expression pattern;
   (2) administering the test agent to the mammal;
   (3) measuring the expression of the plurality of aging- and cognitive-related genes (ACGs) in the mammal to obtain a test agent-ACG expression pattern;
   (3) comparing the pre-test agent-ACG expression pattern to the drug ACG expression profile obtained for the mammal; and
   (4) correlating a modification of expression of one or more ACGs after administration of the test agent with a predictive effect on treatment of aging-dependent cognitive function decline,
   wherein, said plurality of ACGs are selected from the ACGs listed in Tables 1A and 1B and are selected based on synaptic functional plasticity.

2. The method of claim 1 wherein the modification of the expression pattern of one or more ACGs comprises an upregulation of gene expression.

3. A method of assessing the effect of a test agent on the expression pattern of a plurality of aging- and cognitive-related genes (ACGs) in a subject, the method comprising:
   (1) obtaining a baseline expression pattern of the ACGs in the subject,
   (2) administering the test agent to the subject and measuring the expression pattern of the plurality of the ACGs in the subject,
   (3) comparing the expression pattern from step (2) with the baseline expression pattern of step (1),
   (4) identifying a difference in expression of one or more of the ACGs after administration of the test agent with a predictive effect on treatment of aging-dependent cognitive function decline,
   wherein, said plurality of ACGs are selected from the ACGs listed in Tables 1A and 1B and are selected based on synaptic functional plasticity.

4. The method of claim 3 wherein said subject is a human or a rat.

5. The method of claim 3 wherein the comparing step (3) comprises determining statistical significance using an ANOVA or students t test with $p<0.05$.

6. The method of claim 3 wherein the identifying step (4) comprises correlating aging-dependent cognitive function decline to the differences of expression patterns of steps (1) and (2) using a Pearson's or Spearman's correlation test across age groups with cognitive performance in behavioral testing.

7. A method for evaluating a test agent for the treatment of aging-dependent cognitive function decline comprising the steps of:
   (1) measuring the expression of a plurality of aging- and cognitive-related genes (ACGs) in a mammal to obtain a pre-test-ACG expression pattern;
   (2) administering the test agent to the mammal;
   (3) measuring the expression of the plurality of ACGs in the mammal to obtain a drug-ACG expression pattern;
   (3) comparing the pre-test agent-ACG expression pattern to the test agent ACG expression profile obtained for the mammal; and
   (4) correlating a modification of expression of one or more ACGs after administration of the test agent with a predictive effect on treatment of aging-dependent cognitive function decline,
   wherein, said plurality of ACGs are selected from the ACGs listed in Tables 1A and 1B and are selected based on synaptic functional plasticity.

8. The method of claim 7 wherein the comparing step (3) comprises determining statistical significance using an ANOVA or students t test with $p<0.05$.

9. The method of claim 7 wherein the identifying step (4) comprises correlating aging-dependent cognitive function decline to the differences of expression patterns of steps (1) and (2) using a Pearson's or Spearman's correlation test across age groups with cognitive performance in behavioral testing.

* * * * *